US008592188B2

(12) United States Patent
Franklin et al.

(10) Patent No.: US 8,592,188 B2
(45) Date of Patent: *Nov. 26, 2013

(54) TAILORED OILS PRODUCED FROM RECOMBINANT HETEROTROPHIC MICROORGANISMS

(75) Inventors: Scott Franklin, La Jolla, CA (US); Aravind Somanchi, Redwood City, CA (US); Janice Wee, San Mateo, CA (US); George Rudenko, Mountain View, CA (US); Jeffrey L. Moseley, Redwood City, CA (US); Walt Rakitsky, San Diego, CA (US)

(73) Assignee: Solazyme, Inc., South San Francisco, CA (US)

( * ) Notice: Subject to any disclaimer, the term of this patent is extended or adjusted under 35 U.S.C. 154(b) by 71 days.

This patent is subject to a terminal disclaimer.

(21) Appl. No.: 13/118,365

(22) Filed: May 27, 2011

(65) Prior Publication Data

US 2011/0294174 A1    Dec. 1, 2011

Related U.S. Application Data

(60) Provisional application No. 61/349,774, filed on May 28, 2010, provisional application No. 61/374,992, filed on Aug. 18, 2010, provisional application No. 61/414,393, filed on Nov. 16, 2010, provisional application No. 61/428,192, filed on Dec. 29, 2010.

(51) Int. Cl.
*C12P 7/64* (2006.01)
*C12P 1/00* (2006.01)
*C12N 1/13* (2006.01)

(52) U.S. Cl.
USPC ....... 435/134; 435/41; 435/252.3; 435/254.2; 435/257.2

(58) Field of Classification Search
USPC ................... 435/134, 41, 252.3, 254.2, 257.2
See application file for complete search history.

(56) References Cited

U.S. PATENT DOCUMENTS

| | | |
|---|---|---|
| 2,235,056 A | 3/1941 | Walmesley |
| 3,280,502 A | 10/1966 | Farrow et al. |
| 3,475,274 A | 10/1969 | Harned |
| 3,957,578 A | 5/1976 | Narita et al. |
| 3,983,008 A | 9/1976 | Shinozaki et al. |
| 4,341,038 A | 7/1982 | Bloch et al. |
| 4,373,434 A | 2/1983 | Alexander et al. |
| 4,390,561 A | 6/1983 | Blair et al. |
| 4,519,845 A | 5/1985 | Ou |
| 4,673,490 A | 6/1987 | Subramanian et al. |
| 4,755,467 A | 7/1988 | Scopes et al. |
| 4,901,635 A | 2/1990 | Williams |
| 4,992,605 A | 2/1991 | Craig et al. |
| 5,091,116 A | 2/1992 | Krishnamurthy et al. |
| 5,130,242 A | 7/1992 | Barclay |
| 5,252,198 A | 10/1993 | Harrison et al. |
| 5,270,175 A | 12/1993 | Moll et al. |
| 5,270,177 A | 12/1993 | Ramos Lazcano et al. |
| 5,304,481 A | 4/1994 | Davies et al. |
| 5,338,673 A | 8/1994 | Thepenier et al. |
| 5,354,878 A | 10/1994 | Connemann et al. |
| 5,391,724 A | 2/1995 | Kindl et al. |
| 5,395,455 A | 3/1995 | Scott et al. |
| 5,455,167 A | 10/1995 | Voelker et al. |
| 5,492,938 A | 2/1996 | Kyle et al. |
| 5,518,918 A | 5/1996 | Barclay et al. |
| 5,547,699 A | 8/1996 | Lizuka et al. |
| 5,595,965 A * | 1/1997 | Wiggins ........................ 508/491 |
| 5,597,400 A | 1/1997 | Nonomura et al. |
| 5,680,812 A | 10/1997 | Linsgeseder |
| 5,685,218 A | 11/1997 | Kemper |
| 5,693,507 A | 12/1997 | Daniell et al. |
| 5,711,983 A | 1/1998 | Kyle et al. |
| 5,792,631 A | 8/1998 | Running |
| 5,826,500 A | 10/1998 | Kemper |
| 5,888,947 A | 3/1999 | Lambert et al. |
| 5,900,370 A | 5/1999 | Running |
| 5,968,791 A | 10/1999 | Davies et al. |
| 6,139,897 A | 10/2000 | Goto et al. |
| 6,166,231 A | 12/2000 | Hoeksema |

(Continued)

FOREIGN PATENT DOCUMENTS

| | | |
|---|---|---|
| CN | 1940021 A | 4/2007 |
| CN | 101037639 A | 9/2007 |
| CN | 101130513 A | 2/2008 |
| DE | 2756977 A1 | 6/1978 |
| EP | 1178118 A1 | 2/2002 |
| EP | 1681337 A1 | 7/2006 |
| EP | 1741767 A1 | 1/2007 |
| JP | 60006799 A | 1/1985 |
| JP | 06-253872 A | 9/1994 |
| JP | 2003-102467 A | 4/2003 |

(Continued)

OTHER PUBLICATIONS

Aggelis et al., "Enhancement of single cell oil production by *Yarrowia lipolytica* growing in the presence of *Teucrium polium* L. aqueous extract," Biotechnology Letters, 21:747-749, (1999).

(Continued)

*Primary Examiner* — Chih-Min Kam
(74) *Attorney, Agent, or Firm* — Alston & Bird LLP

(57) ABSTRACT

Methods and compositions for the production of oil, fuels, oleochemicals, and other compounds in recombinant microorganisms are provided, including oil-bearing microorganisms and methods of low cost cultivation of such microorganisms. Microalgal cells containing exogenous genes encoding, for example, a lipase, a sucrose transporter, a sucrose invertase, a fructokinase, a polysaccharide-degrading enzyme, a keto acyl-ACP synthase enzyme, a fatty acyl-ACP thioesterase, a fatty acyl-CoA/aldehyde reductase, a fatty acyl-CoA reductase, a fatty aldehyde reductase, a fatty aldehyde decarbonylase, and/or an acyl carrier protein are useful in manufacturing transportation fuels such as renewable diesel, biodiesel, and renewable jet fuel, as well as oleochemicals such as functional fluids, surfactants, soaps and lubricants.

39 Claims, 1 Drawing Sheet

(56) References Cited

U.S. PATENT DOCUMENTS

| | | |
|---|---|---|
| 6,255,505 B1 | 7/2001 | Bijl et al. |
| 6,338,866 B1 | 1/2002 | Criggall et al. |
| 6,441,208 B2 | 8/2002 | Bijl et al. |
| 6,589,923 B2 | 7/2003 | Lenuck et al. |
| 6,620,427 B2 * | 9/2003 | Lasekan et al. ............... 424/439 |
| 6,680,426 B2 | 1/2004 | Daniell et al. |
| 6,750,048 B2 | 6/2004 | Ruecker et al. |
| 7,053,267 B2 | 5/2006 | Knauf et al. |
| 7,081,567 B2 | 7/2006 | Xue et al. |
| 7,135,620 B2 | 11/2006 | Daniell et al. |
| 7,268,276 B2 | 9/2007 | Ruezinsky et al. |
| 7,309,602 B2 | 12/2007 | David |
| 7,351,558 B2 | 4/2008 | Ruecker et al. |
| 7,468,267 B2 | 12/2008 | Monod et al. |
| 7,662,598 B2 | 2/2010 | Ruecker et al. |
| 7,678,931 B2 | 3/2010 | Fichtali et al. |
| 7,781,193 B2 | 8/2010 | Ruecker et al. |
| 7,851,199 B2 | 12/2010 | Bailey et al. |
| 7,879,591 B2 | 2/2011 | Damude et al. |
| 7,883,882 B2 | 2/2011 | Franklin et al. |
| 7,935,515 B2 | 5/2011 | Franklin et al. |
| 7,939,710 B1 | 5/2011 | Apt et al. |
| 8,029,579 B2 * | 10/2011 | Knuth et al. ..................... 44/388 |
| 8,278,261 B2 | 10/2012 | Day et al. |
| 8,283,483 B2 | 10/2012 | Williams et al. |
| 2002/0012979 A1 | 1/2002 | Berry |
| 2002/0144455 A1 | 10/2002 | Bertrand et al. |
| 2002/0178467 A1 | 11/2002 | Dehesh |
| 2003/0097686 A1 | 5/2003 | Knauf et al. |
| 2003/0211594 A1 | 11/2003 | Rosebrook |
| 2004/0074760 A1 | 4/2004 | Portnoff et al. |
| 2004/0230085 A1 | 11/2004 | Jakkula et al. |
| 2004/0235123 A1 | 11/2004 | Liao et al. |
| 2005/0005333 A1 | 1/2005 | Ruezinsky et al. |
| 2005/0084941 A1 | 4/2005 | Abe et al. |
| 2005/0102716 A1 | 5/2005 | Venkatramesh et al. |
| 2005/0112735 A1 | 5/2005 | Zappi et al. |
| 2005/0262588 A1 | 11/2005 | Dehesh et al. |
| 2005/0266537 A1 | 12/2005 | Chen |
| 2006/0048240 A1 | 3/2006 | Alexandrov et al. |
| 2006/0075522 A1 | 4/2006 | Cleveland et al. |
| 2006/0107346 A1 | 5/2006 | Schneeberger et al. |
| 2006/0122410 A1 | 6/2006 | Fichtali et al. |
| 2006/0153826 A1 | 7/2006 | Arnould et al. |
| 2006/0162006 A9 | 7/2006 | Sherman et al. |
| 2006/0199984 A1 | 9/2006 | Kuechler et al. |
| 2006/0225341 A1 | 10/2006 | Rohr et al. |
| 2007/0004016 A1 | 1/2007 | Picataggio et al. |
| 2007/0009988 A1 | 1/2007 | Monod et al. |
| 2007/0048848 A1 | 3/2007 | Sears |
| 2007/0099280 A1 | 5/2007 | Barclay |
| 2007/0118916 A1 | 5/2007 | Puzio et al. |
| 2007/0167396 A1 | 7/2007 | Dillon et al. |
| 2007/0275438 A1 | 11/2007 | David et al. |
| 2007/0286908 A1 | 12/2007 | Clampitt |
| 2008/0014620 A1 | 1/2008 | Op Den Camp et al. |
| 2008/0038804 A1 | 2/2008 | Du et al. |
| 2008/0160593 A1 | 7/2008 | Oyler |
| 2008/0206379 A1 | 8/2008 | Fabritius et al. |
| 2008/0256666 A1 | 10/2008 | Zhu et al. |
| 2009/0004715 A1 | 1/2009 | Trimbur et al. |
| 2009/0011480 A1 | 1/2009 | Trimbur et al. |
| 2009/0018300 A1 | 1/2009 | Bloom et al. |
| 2009/0035842 A1 | 2/2009 | Trimbur et al. |
| 2009/0047721 A1 | 2/2009 | Trimbur et al. |
| 2009/0061493 A1 | 3/2009 | Trimbur et al. |
| 2009/0099260 A1 | 4/2009 | Namal Senanayake et al. |
| 2009/0142322 A1 | 6/2009 | Ye |
| 2009/0145392 A1 | 6/2009 | Clark et al. |
| 2009/0148918 A1 | 6/2009 | Trimbur et al. |
| 2009/0197312 A1 | 8/2009 | Pastinen et al. |
| 2009/0211150 A1 | 8/2009 | Wu et al. |
| 2009/0234146 A1 * | 9/2009 | Cooney et al. ............... 554/174 |
| 2009/0274736 A1 | 11/2009 | Dillon et al. |
| 2009/0298159 A1 | 12/2009 | Wu et al. |
| 2009/0305942 A1 | 12/2009 | Day et al. |
| 2009/0317878 A1 | 12/2009 | Champagne et al. |
| 2010/0021912 A1 | 1/2010 | Farese et al. |
| 2010/0035320 A1 | 2/2010 | Blanchard et al. |
| 2010/0058651 A1 | 3/2010 | Knuth et al. |
| 2010/0093031 A1 | 4/2010 | Kobayashi et al. |
| 2010/0151112 A1 | 6/2010 | Franklin et al. |
| 2010/0151538 A1 | 6/2010 | Franklin et al. |
| 2010/0151567 A1 | 6/2010 | Franklin et al. |
| 2010/0154293 A1 | 6/2010 | Hom et al. |
| 2010/0170144 A1 | 7/2010 | Day et al. |
| 2010/0196575 A1 * | 8/2010 | Sanchez et al. ............... 426/578 |
| 2010/0239712 A1 | 9/2010 | Brooks et al. |
| 2010/0297292 A1 | 11/2010 | Brooks et al. |
| 2010/0297295 A1 | 11/2010 | Brooks et al. |
| 2010/0297296 A1 | 11/2010 | Brooks et al. |
| 2010/0297323 A1 | 11/2010 | Brooks et al. |
| 2010/0297325 A1 | 11/2010 | Brooks et al. |
| 2010/0297331 A1 | 11/2010 | Brooks et al. |
| 2010/0303957 A1 | 12/2010 | Brooks et al. |
| 2010/0303961 A1 | 12/2010 | Brooks et al. |
| 2010/0303989 A1 | 12/2010 | Brooks et al. |
| 2010/0303990 A1 | 12/2010 | Brooks et al. |
| 2010/0323413 A1 | 12/2010 | Trimbur et al. |
| 2010/0323414 A1 | 12/2010 | Trimbur et al. |
| 2011/0014665 A1 | 1/2011 | Trimbur et al. |
| 2011/0015417 A1 | 1/2011 | Trimbur et al. |
| 2011/0047863 A1 | 3/2011 | Trimbur et al. |
| 2011/0072714 A1 | 3/2011 | Gaertner et al. |
| 2011/0165634 A1 | 7/2011 | Franklin et al. |
| 2011/0190522 A1 | 8/2011 | Trimbur et al. |
| 2011/0203168 A1 | 8/2011 | Franklin et al. |
| 2011/0250658 A1 | 10/2011 | Franklin et al. |
| 2011/0252696 A1 | 10/2011 | Franklin et al. |
| 2011/0256268 A1 | 10/2011 | Franklin et al. |
| 2011/0256282 A1 | 10/2011 | Piechocki et al. |
| 2011/0293785 A1 | 12/2011 | Franklin et al. |
| 2012/0028319 A1 | 2/2012 | Trimbur et al. |
| 2012/0034662 A1 | 2/2012 | Hu et al. |
| 2012/0122192 A1 | 5/2012 | Trimbur et al. |
| 2012/0128851 A1 | 5/2012 | Brooks et al. |
| 2012/0164701 A1 | 6/2012 | Trimbur et al. |
| 2012/0203018 A1 | 8/2012 | Franklin et al. |
| 2012/0277452 A1 | 11/2012 | Franklin et al. |
| 2012/0277453 A1 | 11/2012 | Franklin et al. |
| 2012/0283460 A1 | 11/2012 | Franklin et al. |
| 2012/0288930 A1 | 11/2012 | Trimbur et al. |
| 2012/0324784 A1 | 12/2012 | Franklin et al. |
| 2012/0329109 A1 | 12/2012 | Chua et al. |
| 2013/0004646 A1 | 1/2013 | Franklin et al. |
| 2013/0005005 A1 | 1/2013 | Day et al. |
| 2013/0006006 A1 | 1/2013 | Day et al. |
| 2013/0034887 A1 | 2/2013 | Franklin et al. |
| 2013/0078709 A1 | 3/2013 | Franklin et al. |
| 2013/0089916 A1 | 4/2013 | Franklin et al. |
| 2013/0096211 A1 | 4/2013 | Franklin et al. |
| 2013/0102039 A1 | 4/2013 | Franklin et al. |

FOREIGN PATENT DOCUMENTS

| | | |
|---|---|---|
| WO | WO 92/11373 A1 | 7/1992 |
| WO | WO 94/10288 A2 | 5/1994 |
| WO | WO 95/13390 A2 | 5/1995 |
| WO | WO 99/37166 A1 | 7/1999 |
| WO | WO 99/64618 | 11/1999 |
| WO | WO 00/61740 A1 | 10/2000 |
| WO | WO 2004/101753 A2 | 11/2004 |
| WO | WO 2005/035693 A2 | 4/2005 |
| WO | WO 2007/027669 A1 | 3/2007 |
| WO | WO 2007/038566 A2 | 4/2007 |
| WO | WO 2007/117511 A2 | 10/2007 |
| WO | WO 2007/134294 A2 | 11/2007 |
| WO | WO 2008/002643 A2 | 1/2008 |
| WO | WO 2008/011811 A1 | 1/2008 |
| WO | WO 2008/083352 A1 | 7/2008 |
| WO | WO 2008/130372 A2 | 10/2008 |
| WO | WO 2008/134836 A2 | 11/2008 |
| WO | WO 2008/151149 A2 | 12/2008 |
| WO | WO 2009/126843 A2 | 10/2009 |

(56) References Cited

FOREIGN PATENT DOCUMENTS

| | | |
|---|---|---|
| WO | WO 2010/045368 A2 | 4/2010 |
| WO | WO 2010/063031 A2 | 6/2010 |
| WO | WO 2010/063032 A2 | 6/2010 |
| WO | WO 2010/120923 A1 | 10/2010 |
| WO | WO 2011/090730 A1 | 7/2011 |
| WO | WO 2011/130573 A1 | 10/2011 |
| WO | WO 2011/130576 A1 | 10/2011 |
| WO | WO 2011/130578 A2 | 10/2011 |
| WO | WO 2011/150410 A1 | 12/2011 |
| WO | WO 2011/150410 A2 | 12/2011 |
| WO | WO 2011/150411 A1 | 12/2011 |
| WO | WO 2012/106560 A1 | 8/2012 |
| WO | WO 2012/154626 A1 | 11/2012 |

OTHER PUBLICATIONS

Bigogno et al., "Biosynthesis of arachidonic acid in the oleaginous microalga *Parietochloris incisa* (Cholorphyceae): Radiolabeling studies," Lipids 37(2):209-216 (2002); Abstract Only.
Brown et al., "The amino-acid and sugar composition of 16 species of micralgae used in mariculture," J. Exp. Mar. Biol. Ecol. 145:79-99 abstract (1991).
Dehesh et al., "KAS IV: A 3-ketoacyl-ACP synthase from *Cuphea* sp. is a medium chain specific condensing enzyme," The Plant Journal, 15:383-390, (1998).
Dunahay et al., "Genetic Engineering of Microalgae for Fuel Production," Applied Biochemistry and Biotechnology, 34/35:331-339 (1992).
Fall et al., "Bioconversion of Xylan to Triglycerides by Oil-Rich Yeasts," Applied and Environmental Microbiology, 47(5):1130-1134, (1984).
Ferrentino, "Microalgal oil extraction and in situ transesterification," University of New Hampshire, Pub. No. MT 1447885, 93 pages, (2007).
Ferrentino, et al., "Microalgal oil Extraction and In-situ Transesterification," AIChE Annual Mtg, San Francisco, CA, Nov. 11-13, 2006. Abstract.
Franklin et al., "Prospects for molecular farming in the green alga *Chlamydomonas reinhardtii*," Current Opinion in Plant Biology, 7:159-165, (2004).
Gul et al., "Sterols and the Phytosterol Content in Oilseed Rape (*Brassica napus* L.)," Journal of Cell and Molecular Biology, 5:71-79 (2006).
Hall et al., "Lipid Accumulation in an Oleaginous Yeast (*Candida* 107) Growing on Glucose Under Various Conditions in a One- and Two-Stage Continuous Culture," Applied and Environmental Microbiology, 33(3):577-584, (1977).
Henderson et al., "Lipid Composition and Biosynthesis in the Marine Dinoflagellate *Crypthecodznzum cohnii*," Phytochem. 27(6)1679-1683 (1988).
Kenyon, "Fatty Acid Composition of Unicellular Strains of Blue-Green Algae," J. Bacteriology 109(2):827-834 (1972).
Leon-Banares et al., "Transgenic microalgae as green cell-factories," Trends in Biotechnology, 22(1):45-52, (2004).
Lubitz, "The Protein Quality, Digestibility, and Composition of Algae, *Chlorella* 71105," J. Food Sci. 28(2):229-232 (1963).
Meng et al., "Biodiesel production from oleaginous microorganisms," Renewable Energy, 34:1-5, (2009).
Morris, "Effect of Growth Temperature on the Cryopreservation of Prototheca," Journal of General Microbiology, 94:395-399, (1976).
PCT International Preliminary Report on Patentability (Chapter I) of Aug. 13, 2012 for application PCT/US11/38463.
PCT International Search Report for application PCT/US2011/038463 mailed Jan. 18, 2012.
PCT International Search Report for application PCT/US2012/023696 mailed May 23, 2012.
PCT International Search Report for application PCT/US2012/036690 mailed Aug. 30, 2012.
PCT Written Opinion of the International Searching Authority for application PCT/US2011/038463 mailed Jan. 18, 2012.
PCT Written Opinion of the International Searching Authority for application PCT/US2012/023696 mailed May 23, 2012.
PCT Written Opinion of the International Searching Authority for application PCT/US2012/036690 mailed Aug. 30, 2012.
Petkov et al., "Which are fatty acids of the green alga *Chlorella*?," Biochemical Systematics and Ecology, 35:281-285, (2007).
Powell et al., "Algae Feeding in Humans," J. Nutrition, 75:7-12, (1961).
Ratledge, "Regulation of lipid accumulation in oleaginous microorganisms," Biochem Soc Trans., 30(Pt 6):1047-1050, 2002.
Spolaore et al., "Commercial Applications of Microalgae," J. Biosci. Bioeng. 101(2):87-96 (2006).
Tornabene et al., "Lipid composition of the nitrogen starved green alga *Neochloris oleoabundans*," Enzyme Microb. Technol., 5:435-440, (1983).
U.S. Appl. No. 12/131,783, Final Office Action mailed Jan. 12, 2012.
U.S. Appl. No. 12/131,793, Non-Final Office Action mailed Nov. 13, 2012.
U.S. Appl. No. 12/131,804, Non-Final Office Action mailed Oct. 26, 2012.
U.S. Appl. No. 12/131,804, Non-Final Office Action mailed Jun. 7, 2012.
U.S. Appl. No. 12/628,140, Non-Final Office Action mailed Oct. 30, 2012.
U.S. Appl. No. 12/772,170, Final Office Action mailed Feb. 21, 2012.
U.S. Appl. No. 13/045,500, Non-Final Office Action mailed Mar. 9, 2012.
U.S. Appl. No. 13/045,500, Final Office Action mailed Sep. 26, 2012.
U.S. Appl. No. 13/073,757, Non-Final Office Action mailed Dec. 29, 2011.
U.S. Appl. No. 13/073,757, Notice of Allowance mailed Apr. 17, 2012.
U.S. Appl. No. 13/406,417, Requirement for Restriction/Election mailed Apr. 30, 2012.
Warner et al., "Analysis of Tocopherols and Phytosterols in Vegetable Oils by HPLC with Evaporative Light-Scattering Detection," JAOCS, 67(11):827-831 (1990).
Yu et al., "Modifications of the metabolic pathways of lipid and triacylglycerol production in microalgae," Microbial Cell Factories, 10:91, (2011). [Retrieved from the Internet Jul. 24, 2012: <URL: http://www.microbialcellfactories.com/content/10/1/91>].
Zhao et al., "Medium optimization for lipid production through co-fermentation of glucose and xylose by the oleaginous yeast *Lipomyces starkeyi*," Eur. J. Lipid Sci. Technol., 110:405-412, (2008).
U.S. Appl. No. 60/941,581, filed Jun. 1, 2007, Trimbur et al.
U.S. Appl. No. 60/959,174, filed Jul. 10, 2007, Trimbur et al.
U.S. Appl. No. 60/968,291, filed Aug. 27, 2007, Trimbur et al.
U.S. Appl. No. 61/024,069, filed Jan. 28, 2008, Trimbur et al.
U.S. Appl. No. 61/118,590, filed Jan. 28, 2008, Franklin et al.
U.S. Appl. No. 61/118,994, filed Dec. 1, 2008, Franklin et al.
U.S. Appl. No. 61/174,357, filed Apr. 30, 2009, Franklin et al.
U.S. Appl. No. 61/219,525, filed Jun. 23, 2009, Franklin et al.
"The Artisan Rototherm®," *Artisan Industries Inc.*, Bulletin 9904, 2 pages, (2011). [Retrieved from the Internet Dec. 14, 2011: <URL: http://artisanind.com/ps/docs/rototherm.pdf>].
A Look Back at the U.S. Department of Energy's Aquatic Specis Program: Biodiesel from Algae, NREL/TP-580-24190, John Sheehan, Terri Dunahay, John Benemann and Paul Roessler, (1998).
Abate et al., "Production of ethanol by a flocculent *Saccharomyces* sp. in a continuous uplow reactor using sucrose, sugar-cane juice, and molasses as the carbon source," *MIRCEN Journal*, 3:401-409, (1987).
Abbadi et al., "Knockout of the regulatory site of 3-ketoacyl-ACP synthase III enhances short- and medium-chain acyl-ACP synthesis," *The Plant Journal*, 24(1):1-9, (2000).
Alvarez et al., "Triacylglycerols in prokaryotic microorganisms," *Appl Microbiol Biotechnol*, 60:367-376, (2002).
Angerbauer et al., "Conversion of sewage sludge into lipids by *Lipomyces starkeyi* for biodiesel production," *Bioresource Technology*, 99:3051-3056, (2008).

(56) References Cited

OTHER PUBLICATIONS

Bonaventure et al., "Disruption of the FATB Gene in *Arabidopsis* Dethonstrates an Essential Role of Saturated Fatty Acids in Plant Growth," *The Plant Cell* 15:1020-1033, (2003).

Borza et al., "Multiple Metabolic Roles for the Nonphotosynthetic Plastid of the Green Alga *Prototheca wickerhamii*," *Eukaryotic Cell*, 4(2):253-261, (2005).

Bouchard et al., "Characterization of Depolymerized Cellulosic Residues," *Wood Sci. Technol.*, 23:343-355, (1989).

Broun et al., "A bifunctional oleate 12-hydroxylase: desaturase from *Lesquerella fendleri*," *The Plant Journal*, 13(2):201-210, (1998).

Canakci et al., "Biodiesel production from oils and fats with high free fatty acids," *Transactions of the ASAE*, 44(6)1429-1436, (2001).

Cartens et al,. "Eicosapentaenoic Acid (20:5n-3) from the Marine Microalga *Phaeodactylum tricornutum*," *Journal of the American Oil Chemists' Society*, 73(8):1025-1031, (1996).

Chasan, "Engineering Fatty Acids—The Long and Short of It," *Plant Cell*, 7:235-237, (1995).

Chen et al., "High cell density culture of microalgae in heterotrophic growth," *Trends in Biotechnology*, 14:421-426, (1996).

Chen et al., "Highly Effective Expression of Rabbit Neutrophil Peptide-1 Gene in *Chlorella ellipsoidea* Cells," *Current Genetics*, 39:365-370, (2001).

Chisti et al., "Biodiesel from microalgae," *Biotechnology Advances*, 25:294-306, (2007).

Chow et al., "Electrotranformation of *Chlorella Vulgaris*," *Plant Cell Reports*, 18:778-780, (1999).

Cobley et al., Construction of Shuttle Plasmids Which Can Be Efficiently Mobilized From *Escherichia coli* Into the Chromatically Adapting Cyanobacterium, *Plasmid*, 30:90-105, (1993).

Courchesne et al., "Enhancement of Lipid Production Using Biochemical, Genetic and Transcription Factor Engineering Approaches," *J Biotechnol. Epub*, 141(1-2):31-41, (2009).

Covello et al., "Functional Expression of the Extraplastidial *Arabidopsis thaliana* Oleate Desaturase Gene (FAD2) in *Saccharomyces cerevisiae'*," *Plant Physiol.*, 111:223-226, (1996).

Da Silva et al., "Effect of *n*-dodecane on *Crypthecodinium cohnii* fermentations and DHA production," *J Ind Microbiol Biotechnol*, DOI 10.1007/s10295-006-0081-8, 9 pages (2006).

Dai et al., "Biodiesel generation from oleaginous yeast *Rhodotorula glutinis* with xylose assimilating capacity," *African Journal of Biotechnology*, 6(18):2130-2134, (2007).

Dawson et al., "Stable Transformation of Chlorella: Rescue of Nitrate Reductase-Deficient Mutants with the Nitrate Reductase Gene," *Current Microbiology*, 35:356-362, (1997).

Dehesh et al., "Production of high levels of 8:0 and 10:0 fatty acids in transgenic canola by overexpression of Ch FatB2, a thioesterase cDNA from *Cuphea hookeriana*," *The Plant Journal*, 9(2):167-172, (1996).

Demirbas, "Fuel Conversional Aspects of Palm Oil and Sunflower Oil," *Energy Sources*, 25:457-466, (2003)

Deng et al., "Ionic Liquid as a Green Catalytic Reaction Medium for Esterifications," *J. Mol. Catalysis A: Chemical*, 165:33-36, (2001).

Dunahay et al., "Manipulation of Microalgal Lipid Production Using Genetic Engineering," *Applied Biochemistry and Biotechnology*, 57/58:223-231, (1996).

Eccleston et al., "Medium-chain Fatty Acid Biosynthesis and Utilization in *Brassica mapus* Plants Expressing Lauroyl-Acyl Carrier Protein Thioesterase," *Planta* 198:46-53, (1996).

El-Fadaly et al., "Single Cell Oil Production by an Oleaginous Yeast Strain in a Low Cost Cultivation Medium," *Research Journal of Microbiology*, 4(8):301-313, (2009).

El-Sheekh et al., "Variation of Some Nutritional Constituents and Fatty Acid Profiles of *Chlorella vulgaris* Beijerinck Grown under Auto and Heterotrophic Conditions," *International Journal of Botany*, 5(2):153-159, (2009).

El-Sheekh, MM., "Stable Transformation of the Intact Cells of *Chlorella kessleri* With High Velocity Microprojectiles," Biologia Plantarium 42(2): 209-216, (1999).

European Search Report and European Search Opinion for application EP08769988 mailed Jul. 1, 2011.

European Search Report and European Search Opinion for application EP11158642 mailed Jul. 1, 2011.

Evans et al., "A comparison of the oleaginous yeast, *Candida curvata*, grown on different carbon sources in continuous and batch culture," *Lipids*, 18(09):623-629, (1983).

Facciotti et al., "Improved stearate phenotype in transgenic canola expressing a modified acyl-acyl carrier protein thioesterase," *Nat Biotechnol.*, 17(6):593-597, (1999).

Falciatore et al., "Transformation of Nonselectable Reporter Genes in Marine Diatoms," *Marine Biotechnology*; 1:239-251, (1999).

Fukuda et al., "Biodiesel Fuel Production by Transesterification of Oils," *J. Biosci. Bioeng.*, 92(5):405-416, (2001).

GenBank: "Codon Usage Database file for *Chlorella vulgaris*," Jun. 2007. [Retrieved from the Internet Aug. 26, 2010: <URL: http://www.kazusa.or.jp/codon/cgi-bin/showcodon.cgi?species=3077 >].

GenBank: Accession No. L42851.1, "*Prototheca wickerhamii* large subunit ribosomal RNA (rrnL) gene, partial sequence; chloroplast gene for chloroplast product," Nov. 21, 2001.

Gill et al., "Lipid Accumulation in an Oleaginous Yeast (Candida 107) Growing on Glucose in Single-Stage Continuous Culture," *Applied and Environmental Microbiology*, 33(02):231-239, (1977).

Grinna et al., "Size Distribution and General Structural Features of N-Linked Oligosaccharides from the Methylotrophic Yeast, *Pichia pastoris*," *Yeast*, 5:107-115, (1989).

Guo-Zhong et al., "The Actin Gene Promoter-driven Bar as a Dominant Selectable Marker for Nuclear Transformation of *Dunaliella salina*," Acta Genetica Sinica, 32(4): 424-433, (2005).

Gusakov et al., "Design of Highly Efficenet Cellulase Mixtures for Enzymatic Hydrolysis of Cellulose," *Biotechnol. and Bioengineering*, 97(5)1028-1038, (2007).

Ha et al., "Engineered *Saccharomyces cerevisiae* capable of simultaneous cellobiose and xylose fermentation," *PNAS*, 108(2):504-509, (2011).

Hall et al., "Lipid Accumulation in an Oleaginous Yeast (Candida 107) Growing on Glucose Under Various Conditions in a One- and Two-Stage Continuous Culture," *Applied and Environmental Microbiology*, 33(3):577-584, (2009).

Hallman et al., "Reporter Genes and Highly Regulated Promoters as Tools for Transformation Experiements in Volvox Carteri," *Proc Natl Acad Sci U S A.*, 91(24):11562-11566, (1994).

Hawkins et al., "Expression of Human Growth Hormone by the Eukaryotic Alga, *Chlorella*," Current Microbiology, 38:335-341, (1999).

Heifetz, "Genetic Engineering of the Chloroplast," *Biochimie*, 82:655-666, (2000).

Heise et al., "Factors Controlling Medium-Chain Fatty Acid Synthesis in Plastids From *Cuphea* Embryos," *Prog. Lipid Res.*, 33(1/2):87-95, (1994).

Helmensteine, "Gasoline and Octane Ratings," About.com, Chemistry, 1 page, (2011). [Retrieved from the Internet Oct. 3, 2011: <URL: http://chemistry.about.com/cs/howthingswork/a/aa070401a.htm>].

Heredia et al., "Simultaneous utilization of glucose and xylose by *Candida curvata* D in continuous culture," *Biotechnology Letters*, 10(01):25-30, (1988).

Hossain et al., "The effect of the sugar source on citric acid production by *Aspergillus niger*," *Appl Microbiol Biotechnol*, 19:393-397, (1984).

Hsieh et al., "A PII-like Protein in *Arabidopsis*: Putative Role in Nitrogen Sensing," *Proc Natl Acad Sci USA*, 95(23):13965-13970, (1998).

Hu et al., "Microalgal Triacylglycerols as Feedstocks for Biofuel Production: Perspectives and Advances," *The Plant Journal* 54:621-639, (2008).

Huang et al., "Expression of Mercuric Reductase From Bacillus Megaterium MB1 in Eukaryotic *Microalga chlorella* sp. DT: An Approach for Mercury Phytoremediation," *Appl. Microbiol. Biotechnol.*, 72:197-205, (2006).

Huber et al., "Production of Liquid Alkanes by Aqueous-Phase Processing of Biomass-Derived Carbohydrates," *Science*, 308:1446-1450, (2005).

(56) References Cited

OTHER PUBLICATIONS

Huber et al., "Synthesis of Transportation Fuels from Biomass: Chemistry, Catalysts, and Engineering," *Chem. Rev.*, 106: 4044-4098, (2006).
Jarvis et al. "Transient Expression of Firefly Luciferase in Protoplasts of the Green Alga *Chlorella ellipsoidea*," *Current Genet.*, 19: 317-322, (1991).
Jaworski et al., "Industrial oils from transgenic plants," *Current Opinion in Plant Biology*, 6:178-184, (2003).
Jeoh et al., "Cellulase Digestibility of Pretreated Biomass Is Limited by Cellulose Acessibility," *Biotechnol Bioeng.*, 98(1):112-122, (2007).
Jha et al., "Cloning and functional expression of an acyl-ACP thioesterase FatB type from Diploknema (Madhuca) butyracea seeds in *Escherichia coli*," *Plant Physiology and Biochemistry*, 44:645-655, (2006).
Kalscheuer et al., "Establishment of a Gene Transfer System for Rhodococcus opacus PD630 Based on Electroporation and its Application for Recombinant Biosynthesis of Poly(3-hyroxyalkanoic acids)," *Applied Microbiology and Biotechnology*, 52(4):508-515, (1999).
Kang et al., "The regulation activity of *Chlorella* virus gene 5' upstream sequence in *Escherichia coli* and eucaryotic alage," *Institute of Microbiology, Chinese Academy of Sciences, Beijing*, 16(4):443-6, (2000). Abstract only.
Katayama et al., "Alpha-Linolenate and Photosynethetic Activity in *Chlorella protothecoides*," *Plant Physiol.*, 42:308-313, (1967).
Kim et al. "Stable Integraion and Functional Expression of Flounder Growth Hormone Gene in Tranformed Microalga, *Chlorella ellipsoidea*," (*Mar. Biotechnol.* 4:63-73 (2002).
Koksharova, "Genetic Tools for Cyanobacteria," *Appl Microbiol Biotechnol*, 58(2):123-37, (2002).
Kong et al., "Microbial production of lipids by cofermentation of glucose and xylose with *Lipomyces starkeyi* 2#," *Chinese Journal of Bioprocess Engineering*, 05(02):36, (2007). Abstract.
Lawford et al., "Performance Testing of *Zymomonas mobilis* Metabolically Engeineered for Confermation of Glucose, Xylose, and Arabinose," *Appl Biochem Biotechnol*. 98-100:429-48, (2002).
Li et al., "Large-scale biodiesel production from microalga *Chlorella protothecoides* through heterotrophic cultivation in bioreactors," *Biotechnology and Bioengineering*, 98(04):764-771, (2007).
Li et al., "Articles: Biocatalysts and Bioreactor Design, Biofuels From Microalgae," *Biotechnol. Prog.*, 24:815-820, (2008).
Li et al., "Enzymatic transesterification of yeast oil for biodiesel fuel production," *The Chinese Journal of Process Engineering*, 07(01):137-140 (2007), and machine translation.
Li et al., "High-density cultivation of oleaginous yeast *Rhodosporidium toruloides* Y4 in fed-batch culture," *Enzyme and Microbial Technology*, 41:312-317, (2007).
Li et al., "Screening of oleaginous yeasts for broad-spectrum carbohydrates assimilating capacity," *China Biotechnology*, 25(12):39-44 (2005), and machine translation.
Liu et al., "Biodiesel production by direct methanolysis of oleaginous microbial biomass," *Journal of Chemical Technology and Biotechnology*, 82:775-780, (2007).
Lumbreras et al., "Efficient Foreign Gene Expression in *Chlamydomonas reinhardtii* Mediated by an Endogenous Intron," *Plant Journal*, 14(4):441-447, (1998).
Maruyama et al., "Introduction of Foreign DNA Into *Chlorella Saccharophila* by Electroporation," *Biotechnology Techniques*, 8:821-826, (2004).
Matsuka et al., *Plant and Cell Physiol.*, 7:149-162 (1966).
Mayer et al., "A Structural Model of the Plant Acyl-Acyl Carrier Protein Thioesterase FatB Comprises Two Helix/4-Stranded Sheet Domains, the N-terminal Domain Containing Residues That Affect Specificity and the C-terminal Domain Containing Catalytic Residues," *The Journal of Biological Chemistry*, 280(5):3621-3627, (2005).

Meesters et al., "High-cell-density cultivation of the lipid accumulating yeast *Cryptococcus curvatus* using glycerol as a carbon source," *Applied Microbiology and Biotechnology*, 45:575-579, (1996).
Mekhedov et al., "Toward a Functional Catalog of the Plant Genome. A Survey of Genes for Lipid Biosynthesis," *Plant Physiology*, 122:389-401, (2000).
Miao et al., "Biodiesel Production From Heterotrophic Microalgal Oil," *Biosource Technology*, 97(06):841-846, (2006).
Miao et al., "High Yield Bio-Oil Production from Fast Pyrolysis by Metabolic Controlling of *Chlorella protothecoides*," *J. Biotech.*, 110:85-93, (2004).
Muller et al., "Nitrogen and hormonal responsiveness of the 22 kDa alpha-zein and b-32 genes in maize endosperm is displayed in the absence of the transcriptional regulator Opaque-2," *Plant J.*, 12(2):281-291, Abstract, (1997).
Murakami et al., "Lipid Composition of Commercial Bakers' Yeasts Having Different Freeze-tolerance in Frozen Dough," *Biosci. Biotechnol. Biochem.*, 60(11)1874-1876, (1996).
Nes et al., "Sterol phylogenesis and algal evolution," *Proc Natl Acad Sci U S A*, 87(19):7565-7569, (1990).
Onai et al., "Natural Tranformation of the Termophillic Cyanbacterium *Thermosynechococcus elongatus* BP-1: A Simple and Efficicent Method for Gene Transfer," *Mol Genet Genomics*, 271(1):50-9, (2004).
Papanikolaou et al., "Lipid production by *Yarrowia lipolytica* growing on industrial glycerol in a single-stage continuous culture," *Bioresource Technology*, 82:43-49, (2002).
Papanikolaou et al., *J. Chem. Technol. Biotechnol.*, 79: 1189-1196 (2004).
Park et al., "Isolation and Characterization of *Chlorella* Virus From Fresh Water in Korea and Application in *Chlorella* Transformation System," *Plant Pathol. J.*, 21(1):13-20, (2005).
PCT International Preliminary Report on Patentability (Chapter I) of Dec. 7, 2009 for application PCT/US08/65563.
PCT International Preliminary Report on Patentability (Chapter I) of May 31, 2011 for application PCT/US09/066142.
PCT International Preliminary Report on Patentability (Chapter I) of Oct. 12, 2010 for application PCT/US2009/040123.
PCT Search Report for application PCT/US2009/040123 mailed Oct. 5, 2009.
PCT Search Report for application PCT/US2011/0032582 mailed Aug. 9, 2011.
PCT Search Report for application PCT/US2011/038464 mailed Nov. 3, 2011.
PCT Search Report of Aug. 20, 2010 for application PCT/US2009/066142.
PCT Search Report of Nov. 5, 2010 for application PCT/US2009/066141.
PCT Search Report of Nov. 6, 2008 for application PCT/US08/65563.
PCT Written Opinion of the International Search Authority of Aug. 20, 2010 for application PCT/US2009/066142.
PCT Written Opinion of the International Searching Authority for application PCT/US2011/0032582 mailed Aug. 9, 2011.
PCT Written Opinion of the International Searching Authority for application PCT/US2011/038464 mailed Nov. 3, 2011.
PCT Written Opinion of the International Searching Authority of Nov. 6, 2008 for application PCT/US08/65563.
PCT Written Opinion of the International Searching Authority of Nov. 5, 2010 for application PCT/US2009/066141.
Popov et al., "Separation of the total lipid extract of microalgae," Doklady Akademii Sel 'skokhozyaistvennykh Nauk v Bolgarii, 3(1):45-54, (1970). Abstract only.
Radakovits et al., "Genetic Engineering of Algae for Enhanced Biofuel Production," *Eukaryotic Cell*, 9(04): 486-501, (2010).
Rastogi et al., "Footprinting of the spinach nitrite reductase gene promoter reveals the preservation of nitrate regulatory elements between fungi and higher plants," *Plant Mol Biol.*, 34(3):465-476, Abstract (1997).

(56) References Cited

OTHER PUBLICATIONS

Rehm et al., "Heterologous expression of the acyl-acyl carrier protein thioesterase gene from the plant *Umbellularia califomica* mediates polyhydroxyalkanoate biosynthesis in recombinant *Escherichia coli*," *Appl Microbiol Biotechnol*, 55:205-209, (2001).
Rosenberg et al., "A Green Light for Engineered Algae: Redirecting Metabolism to Fuel a Biotechnology Revolution," *Current Opinion in Biotechnology. Tissue, Cell and Pathyway Engineering*, E-Pub 19:430-436, (2008).
Roy et al., "Production of Intracellular Fat by the Yeast *Lipomyces starkeyi*," *Indian Journal of Experimental Biology*, 16(4):511-512, (1978).
Running et al., "Extracellular production of L-ascorbic acid by *Chlorella protothecoides, Prototheca* species, and mutants of *P. moriformis* during aerobic culturing at low pH," Journal of Industrial Microbiology & Biotechnology, 29:93-98, (2002).
Running et al., "The pathway of L-ascorbic acid biosynthesis in the colourless microalga *Prototheca moriformis*," *Journal of Experimental Botany*, 54(389):1841-1849, (2003).
Salou et al., "Growth and Energetics of *Leuconostoc oenos* during Cometabolism of Glucose with Citrate or Fructose," *Applied and Environmental Microbiology*, 60(5):1459-1466, (1994).
Schütt et al., "The role of acyl carrier protein isoforms from *Cuphea lanceolata* seeds in the de-novo biosynthesis of medium-chain fatty acids," Publication, *Planta*, 205:263-268, (1998).
Schütt et al., "β-Ketoacyl-acyl carrier protein synthase IV: a key enzyme for regulation of medium-chain fatty acid synthesis in *Cuphea lanceolata* seeds," *Planta*, 215:847-854, (2002).
Son et al., "Induction and Cultures of Mountain Genseng Adventitious Roots and AFLP Analysis for Identifying Mountain Ginseng," *Biotechnol. Bioprocess Eng.*, 4:119-123, (1999).
Sud et al., "Lipid Composition and Sensitivity of *Prototheca wickerhamii* to Membrane-Active Antimicrobial Agents," *Antimicrobial Agents and Chemotherapy*, 16 486-490, (1979).
Suh et al., "What limits production of unusual monoenoic fatty acids in transgenic plants?," *Planta*, 215:584-595, (2002).
Takashima et al., "Further Notes on the Growth and Chlorophyll Formation of *Chlorella Protothecoides*," *Plant & Cell Physiol.*, 5:321-332, (1964).
Tan et al., "Saponified Palm Kernel Oil and Its Major Free Fatty-Acids as Carbon Substrates for the Production of Polyhydroxyalkanoates in Pseudomonas-Putida Pga1," *Applied Microbiology and Biotechnology*, 47(3):207-211, (1997).
Tan et al., "Establishment of a Micro-Particle Bombardment Transformation System for *Dunaliella salina*," *J Microbiol.*;43(4):361-365, (2005).
Taylor et al., "Continuous Fermentation and Stripping of Ethanol," *Biotechnol Prog.*, 11(6):693-698, (1995).
Thavarungkul et al., "Batch injection analysis for the determination of sucrose in sugar cane juice using immobilized invertase and thermometric detection," *Biosensors & Bioelectronics*, 14:19-25, (1999).
Thiry et al., "Optimizing scale-up fermentation processes," *Trends in Biotechnology*, 20:103-105, (2002).
Trimble et al., "Structure of Oligosaccharides on Saccharomyces SUC2 Invertase Secreted by the Methylotrophic Yeast *Pichia astoris*," *J. Biol. Chem.*, 266(34):22807-22817, (1991).
U.S. Appl. No. 12/131,766, Advisory Action mailed Oct. 13, 2011.
U.S. Appl. No. 12/131,766, Non-Final Office Action mailed Aug. 1, 2011.
U.S. Appl. No. 12/131,766, Non-Final Office Action mailed Dec. 10, 2009.
U.S. Appl. No. 12/131,766, Non-Final Office Action mailed Nov. 23, 2010.
U.S. Appl. No. 12/131,766, Requirement for Restriction/Election mailed Aug. 17, 2010.
U.S. Appl. No. 12/131,766, Requirement for Restriction/Election mailed Aug. 5, 2009.
U.S. Appl. No. 12/131,773, Final Office Action mailed Mar. 21, 2011.
U.S. Appl. No. 12/131,773, Non-Final Office Action mailed Jun. 25, 2010.
U.S. Appl. No. 12/131,773, Non-Final Office Action mailed Dec. 15, 2009.
U.S. Appl. No. 12/131,773, Requirement for Restriction/Election mailed Aug. 6, 2009.
U.S. Appl. No. 12/131,783, Non-Final Office Action mailed Jun. 6, 2011.
U.S. Appl. No. 12/131,783, Requirement for Restriction/Election mailed Apr. 19, 2011.
U.S. Appl. No. 12/131,793, Final Office Action mailed Mar. 30, 2010.
U.S. Appl. No. 12/131,793, Non-Final Office Action mailed Sep. 16, 2009.
U.S. Appl. No. 12/131,793, Requirement for Restriction/Election mailed Aug. 6, 2009.
U.S. Appl. No. 12/131,804, Final Office Action mailed Feb. 2, 2011.
U.S. Appl. No. 12/131,804, Non-Final Office Action mailed Mar. 3, 2010.
U.S. Appl. No. 12/131,804, Requirement for Restriction/Election mailed Nov. 18, 2009.
U.S. Appl. No. 12/131,804, Requirement for Restriction/Election mailed Sep. 17, 2009.
U.S. Appl. No. 12/194,389, Final Office Action mailed Jan. 5, 2011.
U.S. Appl. No. 12/194,389, Non-Final Office Action mailed Feb. 4, 2010.
U.S. Appl. No. 12/194,389, Requirement for Restriction/Election mailed Oct. 5, 2010.
U.S. Appl. No. 12/194,389, Requirement for Restriction/Election mailed Nov. 2, 2009.
U.S. Appl. No. 12/499,033, Final Office Action mailed Oct. 19, 2011.
U.S. Appl. No. 12/499,033, Non-Final Office Action mailed Feb. 18, 2011.
U.S. Appl. No. 12/499,033, Requirement for Restriction/Election mailed Oct. 15, 2010.
U.S. Appl. No. 12/628,144, Final Office Action mailed Nov. 16, 2010.
U.S. Appl. No. 12/628,144, Final Office Action mailed Dec. 5, 2011.
U.S. Appl. No. 12/628,144, Non-Final Office Action mailed Jul. 8, 2010.
U.S. Appl. No. 12/628,144, Non-Final Office Action mailed Jun. 7, 2011.
U.S. Appl. No. 12/628,147, Examiner Interview Summary Record mailed Mar. 3, 2011.
U.S. Appl. No. 12/628,147, Final Office Action mailed Oct. 1, 2010.
U.S. Appl. No. 12/628,147, Non-Final Office Action mailed May 25, 2010.
U.S. Appl. No. 12/628,147, Non-Final Office Action mailed Oct. 25, 2011.
U.S. Appl. No. 12/628,149, Non-Final Office Action mailed Jun. 25, 2010.
U.S. Appl. No. 12/628,149, Non-Final Office Action mailed Sep. 16, 2010.
U.S. Appl. No. 12/628,149, Notice of Allowance mailed Dec. 15, 2010.
U.S. Appl. No. 12/628,150, Non-Final Office Action mailed Apr. 29, 2010.
U.S. Appl. No. 12/628,150, Non-Final Office Action mailed Oct. 13, 2010.
U.S. Appl. No. 12/628,150, Notice of Allowance mailed Mar. 21, 2011.
U.S. Appl. No. 12/772,163, Requirement for Restriction/Election mailed Jun. 24, 2011.
U.S. Appl. No. 12/772,164, Non-Final Office Action mailed Oct. 12, 2011.
U.S. Appl. No. 12/772,164, Requirement for Restriction/Election mailed Jul. 20, 2011.
U.S. Appl. No. 12/772,170, Non-Final Office Action mailed Sep. 13, 2011.
U.S. Appl. No. 12/772,170, Requirement for Restriction/Election mailed Jul. 13, 2011.
U.S. Appl. No. 12/772,173, Requirement for Restriction/Election mailed Oct. 26, 2011.
U.S. Appl. No. 12/772,174, Non-Final Office Action mailed Nov. 29, 2011.

(56) References Cited

OTHER PUBLICATIONS

U.S. Appl. No. 12/772,174, Requirement for Restriction/Election mailed Aug. 10, 2011.
U.S. Appl. No. 12/981,409, Requirement for Restriction/Election mailed Oct. 28, 2011.
U.S. Appl. No. 13/029,061, Requirement for Restriction/Election mailed Nov. 29, 2011.
U.S. Appl. No. 13/073,757, Non-Final Office Action mailed Aug. 15, 2011.
UNIPROT Accession No. P41758. Phosphoglycerate kinase, chloroplastic. Nov. 25, 2008. [Retrieved from the Internet Aug. 12, 2010: <http://www.uniprot.org/uniprot/P41758.txt?version=46>].
UNIPROT Accession No. P41758. Phosphoglycerate kinase, chloroplastic. Jul. 22, 2008. [Retrieved from the Internet Aug. 25, 2010: <http://http://www.uniprot.org/uniprot/P41758.txt?version=44>]; amino acids 1-60.
Van De Loo et al., "An oleate 12-hydroxylase from *Ricinus communis* L. is a fatty acyl desaturase homolog," *Proc. Natl. Acad. Sci. USA*, 92:6743-6747, (1995).
Van Gerpen, "Commercial Biodiesel Production," Oilseed and Biodiesel Workshop, Billings, Montana, Jan. 9, 2008, downloaded from http://www.deq.state.mt.us/Energy/bioenergy/Biodiesel_Production_Educ_Presentations/10Montana_Production_Jan_2008_JVP.pdf on Mar. 10, 2010.
Van Gerpen, *Fuel Processing Technology*, 86:1097-1107 (2005).
Voelker et al., "Alteration of the Specificity and Regulation of Fatty Acid Synthesis of *Escherichia coli* by Expression of a Plant Medium Chain Acyl-Acyl Carrier Protein Thioesterase," *Journal of Bacteriology*, 176(23):7320-7327, (1994).
Voelker et al., "Broad-Range and Binary-Range Acyl-Acyl-Carrier-Protein Thioesterases Suggest an Alternative Mechanism for Medium-Chain Production in Seeds," *Plant Physiol.*, 114:669-677, (1997).
Voetz et al., "Three Different cDNAs Encoding Acyl Carrier Proteins from *Cuphea Ianceolata'*," *Plant Physiol.*, 106:785-786, (1994).
Wang et al., "Quantitative estimate of the effect of cellulase components during degradation of cotton fibers," *Carbohydrate Research*, 339:819-824, (2004).
Westphal, et al., "Vipp1 Deletion Mutant of Synechocystis: A Connection Between Bacterial Phage Shock and Thylakoid Biogenesis," *Proc Natl Acad Sci U S A.*, 98(7):4243-4248, (2007).
Wiberg et al., "The distribution of caprylate, caprate and laurate in lipids from developing and mature seeds of transgenic *Brassica napus* L.," *Planta*, 212:33-40, (2000).
Wirth et al., "Transforamtion of Various Species of Gram-Negitive Bacteria Belonging to 11 Difference Genera by Electroporation," *Mol Gen Genet.*; 216(1):175-177, (1989).
Wolk et al., "Construction of Shuttle Vectors Capable of Conjugative Transfer From *Escherichia coli* to Nitrogen-Fixing Filamentous Cyanobacteria," *Proc Natl Acad Sci USA.*, 81(5):1561-1565, (1984).
Wu et al., "A Comparative Study of Gases Generated from Simvlant Thermal Degradation of Autotrophic and *Heterotrophic chorella*," *Progress in Natural Science*, 2(4):311-318, (1992).
Wu et al., "New Discoveries in Study on Hydrocarbons From Thermal Degradation of Heterotrophically Yellowing Algae," *Science In China*, 37(3):326-35, (1994).
Wyman et al., "Comparative Sugar Recovery Data From Laboratory Scale Application of Leading Pretreatment Technologies to Corn Stover," *Bioresour Technol.*, 96(18):2026-2032, (2005).
Xu et al., "High quality biodiesel production from a microalga *Chlorella* protothecoides by heterotrophic growth in fermenters," *Journal of Biotechnology*, 126:499-507, (2006).
Zarowska et al., "Production of Citric Acid on Sugar Beet Molasses by Single and Mixed Cultures of *Yarrowia lipolytica*," *Electronic Journal of Polish Agricultural Universities*, 4(2):1-7, (2001). [Retrieved from the Internet Oct. 3, 2011: <URL: http://www.ejpau.media.pl/volume4/issue2/biotechnology/art-01.html>].
Zhao et al., "Toward cheaper microbial oil for biodiesel oil," *China Biotechnology*, 25(02):8-11 (2005).

Bohacenko et al., "Detection of Olive Oils Authenticity by Determination of their Sterol Content using LC/GC," *Czech J. Food Sci.*, 19(3):97-103, (2001).
Nes et al., "Biosynthesis of Cholesterol and Other Sterols," *Chem. Rev.*, 111:6423-6451, (2011).
Bornscheuer et al. (ed), "Enzymes in Lipid Modification," Wiley-VCH Verlag Gmbh & Co. KGaA, 1st Edition, ISBN: 3-527-30176-3, Sections 1-11, 231 pages, (2000). (part 1 of 2 of book).
Bornscheuer et al. (ed), "Enzymes in Lipid Modification," Wiley-VCH Verlag Gmbh & Co. KGaA, 1st Edition, ISBN: 3-527-30176-3, Sections 12-18, 133 pages, (2000). (part 2 of 2 of book).
De Cock, "Structure development in confectionery products: importance of triacylglycerol composition," Master Thesis, Masters in Bioscience Engineering, Ghent University, 73 pages, (2011).
List et al., "Melting properties of some structures lipids native to high stearic acid soybean oil," *Grasas y Aceites*, 55(Fasc. 2):135-137, (2004).
Nahm, "Quality Characteristics of West African Shea Butter (*Vitellaria paradoxa*) and Approaches to Extend Shelf-Life," Master Thesis, Master of Science in Food Service, Rutgers, The State University of New Jersey, 133 pages, (2011).
Nazaruddin et al., "The Effect of Enzymatic Alcoholysis on the Physicochemical Properties of Commercial Cocoa Butter Substitutes," *Pakistan Journal of Nutrition*, 10(8):718-723, (2011).
Patil et al., "Fatty acid composition of 12 microalgae for possible use in aquaculture feed," *Aquacult Int*, 15:1-9, (2007).
Talbot et al., "Formulation and Production of Confectionery Fats," OFI Middle East 2007 Conference and Exhibition, 378 pages, (2007).
U.S. Appl. No. 12/131,793, Non-Final Office Action mailed Apr. 3, 2013.
U.S. Appl. No. 12/131,793, Non-Final Office Action mailed Jun. 21, 2012.
U.S. Appl. No. 12/131,793, Notice of Allowance mailed Apr. 3, 2013.
U.S. Appl. No. 12/628,140, Final Office Action mailed Mar. 15, 2013.
U.S. Appl. No. 12/628,147, Final Office Action mailed Jul. 12, 2012.
U.S. Appl. No. 12/772,163, Non-Final Office Action mailed May 25, 2012.
U.S. Appl. No. 12/772,163, Non-Final Office Action mailed Dec. 12, 2012.
U.S. Appl. No. 12/772,164, Final Office Action mailed May 24, 2012.
U.S. Appl. No. 12/772,173, Final Office Action mailed May 7, 2012.
U.S. Appl. No. 12/772,173, Notice of Allowance mailed Mar. 29, 2013.
U.S. Appl. No. 12/772,173, Non-Final Office Action mailed Dec. 16, 2011.
U.S. Appl. No. 12/960,388, Requirement for Restriction/Election mailed Apr. 1, 2013.
U.S. Appl. No. 12/981,409, Non-Final Office Action mailed Jan. 6, 2012.
U.S. Appl. No. 12/981,409, Notice of Allowance mailed May 29, 2012.
U.S. Appl. No. 12/981,409, Requirement for Restriction/Election mailed Apr. 19, 2012.
U.S. Appl. No. 13/087,311, Non-Final Office Action mailed Apr. 23, 2013.
U.S. Appl. No. 13/406,417, Non-Final Office Action mailed Nov. 5, 2012.
U.S. Appl. No. 13/479,200, Non-Final Office Action mailed Apr. 10, 2013.
U.S. Appl. No. 13/479,200, Requirement for Restriction/Election mailed Jan. 15, 2013.
U.S. Appl. No. 13/527,480, Requirement for Restriction/Election mailed May 3, 2013.
U.S. Appl. No. 13/543,666, Requirement for Restriction/Election mailed Jan. 3, 2013.
U.S. Appl. No. 13/550,412, Non-Final Office Action mailed Oct. 29, 2012.
U.S. Appl. No. 13/550,412, Notice of Allowance mailed Feb. 21, 2013.
U.S. Appl. No. 13/558,252, Non-Final Office Action mailed Jan. 18, 2013.

(56) References Cited

OTHER PUBLICATIONS

U.S. Appl. No. 13/601,928, Non-Final Office Action mailed Jan. 31, 2013.
U.S. Appl. No. 13/601,928, Notice of Allowance mailed Feb. 26, 2013.
U.S. Appl. No. 13/621,722, Requirement for Restriction/Election mailed Jan. 31, 2013.
U.S. Appl. No. 13/628,039, Requirement for Restriction/Election mailed Mar. 7, 2013.
U.S. Appl. No. 12/628,147, Notice of Allowance and Examiner Initiated Interview Summary mailed Aug. 7, 2012.
Wu et al., "Comparative study on Liposoluble Compounds in Autotrophic and Heterotrophic *Chlorella* Protothecoides," Acta Botanica Sinica, 35(11):849-858, (1992).

* cited by examiner

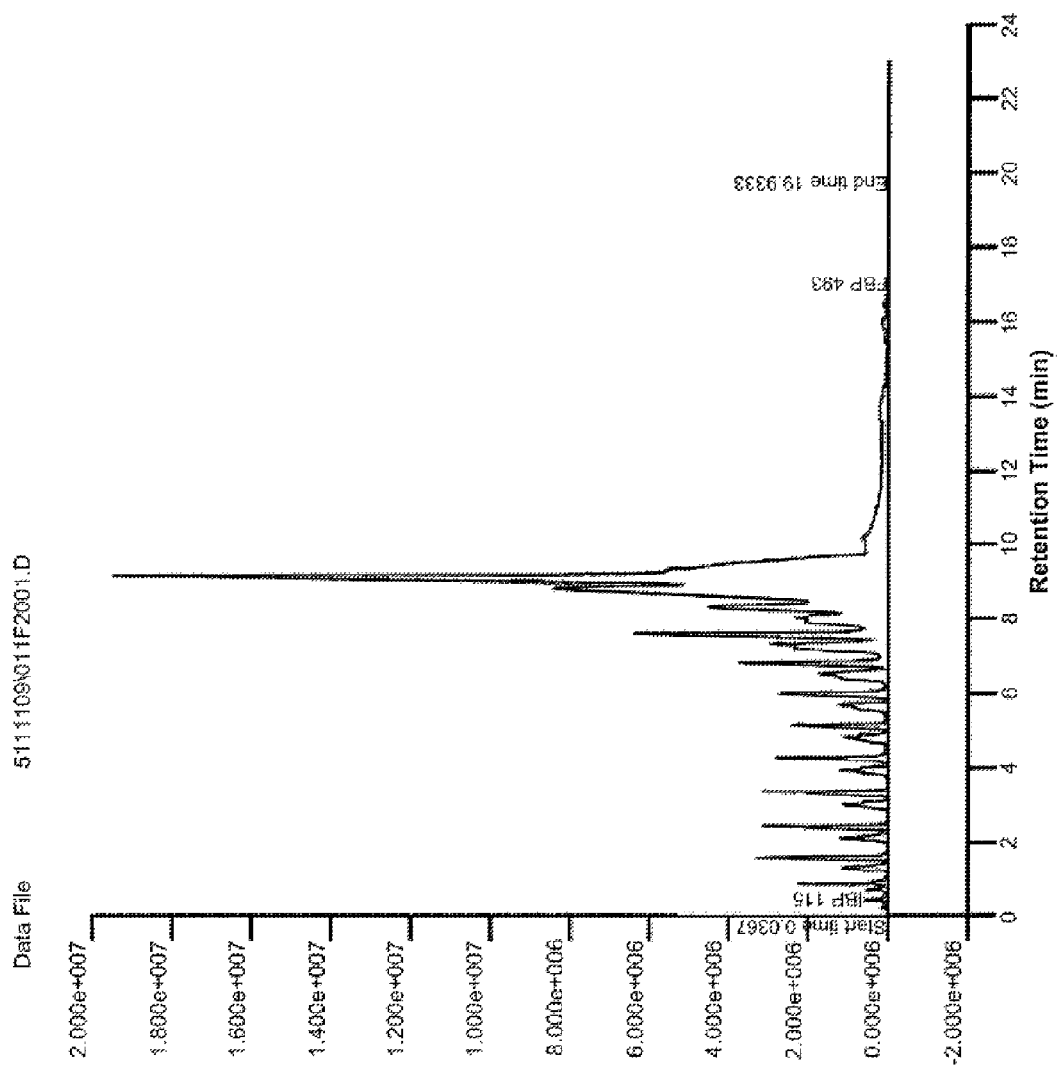

US 8,592,188 B2

TAILORED OILS PRODUCED FROM RECOMBINANT HETEROTROPHIC MICROORGANISMS

CROSS-REFERENCE TO RELATED APPLICATIONS

This application claims the benefit under 35 U.S.C. 119(e) of U.S. Provisional Patent Application No. 61/349,774, filed May 28, 2010, U.S. Provisional Patent Application No. 61/374,992, filed Aug. 18, 2010, U.S. Provisional Patent Application No. 61/414,393, filed Nov. 16, 2010, and U.S. Provisional Patent Application No. 61/428,192, filed Dec. 29, 2010. Each of these applications is incorporated herein by reference in its entirety for all purposes.

REFERENCE TO A SEQUENCE LISTING

This application includes a Sequence Listing as shown in pages 1-514, appended hereto.

FIELD OF THE INVENTION

The present invention relates to the production of oils, fuels, and oleochemicals made from microorganisms. In particular, the disclosure relates to oil-bearing microalgae, methods of cultivating them for the production of useful compounds, including lipids, fatty acid esters, fatty acids, aldehydes, alcohols, and alkanes, and methods and reagents for genetically altering them to improve production efficiency and alter the type and composition of the oils produced by them.

BACKGROUND OF THE INVENTION

Fossil fuel is a general term for buried combustible geologic deposits of organic materials, formed from decayed plants and animals that have been converted to crude oil, coal, natural gas, or heavy oils by exposure to heat and pressure in the earth's crust over hundreds of millions of years. Fossil fuels are a finite, non-renewable resource. Increased demand for energy by the global economy has also placed increasing pressure on the cost of hydrocarbons. Aside from energy, many industries, including plastics and chemical manufacturers, rely heavily on the availability of hydrocarbons as a feedstock for their manufacturing processes. Cost-effective alternatives to current sources of supply could help mitigate the upward pressure on energy and these raw material costs.

PCT Pub. No. 2008/151149 describes methods and materials for cultivating microalgae for the production of oil and particularly exemplifies the production of diesel fuel from oil produced by the microalgae *Chlorella protothecoides*. There remains a need for improved methods for producing oil in microalgae, particularly for methods that produce oils with shorter chain length and a higher degree of saturation and without pigments, with greater yield and efficiency. The present invention meets this need.

SUMMARY OF THE INVENTION

The present invention provides oleaginous microbial cells, preferably microalgal cells, having distinct lipid profiles, and includes recombinant cells expressing exogenous genes encoding proteins such as fatty acyl-ACP thioesterases. The present invention also provides methods of making lipids and oil-based products, including fuels such as biodiesel, renewable diesel and jet fuel, from such cells.

In a first aspect, the present invention provides oleaginous microbial cells, preferably microalgal cells, having a lipid profile that is at least 1% or at least 5%, preferably at least 3%, C8:0. In some cases, the lipid profile is at least 10% or at least 15%, preferably at least 12%, C8:0. In some embodiments, the cell is a recombinant cell. In some cases, the recombinant cell comprises an exogenous gene encoding an acyl-ACP thioesterase protein that has hydrolysis activity towards fatty acyl-ACP substrates of chain length C8. In some embodiments, the exogenous gene encodes a *Cuphea palustris* acyl-ACP thioesterase. In some cases, the cell is a *Prototheca* cell. In some cases, the cell is of a microalgal genus or species selected from microalgae identified in Table 1.

In a second aspect, the present invention provides oleaginous microbial cells, preferably microalgal cells, having a lipid profile that is at least 4% C10:0. In some cases, the lipid profile is at least 20%, at least 25% or at least 30%, preferably at least 24%, C10:0. In some cases, the ratio of C10:0 to C12:0 is at least 6:1. In some embodiments, the cell is a recombinant cell. In some cases, the recombinant cell comprises an exogenous gene encoding an acyl-ACP thioesterase protein that has hydrolysis activity towards fatty acyl-ACP substrates of chain length C10. In some embodiments, the exogenous gene encodes an acyl-ACP thioesterase protein from a species selected from the group consisting of *Cuphea hookeriana* and *Ulmus americana*. In some cases, the cell is a *Prototheca* cell. In some embodiments, the cell is of a microalgal genus or species selected from microalgae identified in Table 1.

In a third aspect, the present invention provides oleaginous microbial cells, preferably microalgal cells, having a lipid profile that is at least 10% or at least 15%, preferably at least 13%, C12:0. In some cases, the lipid profile is at least 30%, at least 35% or at least 40%, preferably at least 34%, C12:0. In some cases, the ratio of C12 to C14 is at least 5:1. In some cases, the cell is a recombinant cell. In some embodiments, the recombinant cell comprises an exogenous gene encoding an acyl-ACP thioesterase protein that has hydrolysis activity towards fatty acyl-ACP substrates of chain length C12. In some cases, the recombinant cell comprises at least two exogenous genes encoding acyl-ACP thioesterase proteins from *Umbellularia californica* and *Cinnamomum camphora* that have hydrolysis activity towards fatty acyl-ACP substrates of chain length C12. In some embodiments, the cell is a *Prototheca* cell.

In a fourth aspect, the present invention provides oleaginous microbial cells, preferably microalgal cells, having a lipid profile that is at least 5% or at least 15%, preferably at least 10%, C14:0. In some cases, the lipid profile is at least 40%, at least 45%, or at least 50%, preferably at least 43%, C14:0. In some cases, the ratio of C14:0 to C12:0 is at least 7:1. In some cases, the cell is a recombinant cell. In some embodiments, the recombinant cell comprises an exogenous gene encoding an acyl-ACP thioesterase protein that has hydrolysis activity towards fatty acyl-ACP substrates of chain length C14. In some embodiments, the acyl-ACP thioesterase protein is from a species selected from the group consisting of *Cinnamomum camphora* and *Ulmus americana*. In some cases, the cell is a *Prototheca* cell. In some embodiments, the cell is of a microalgal genus or species selected from microalgae identified in Table 1.

In a fifth aspect, the present invention provides oleaginous microbial cells, preferably microalgal cells, having a lipid profile that is at least 10% or at least 20%, preferably at least 15%, C16:0. In some cases, the lipid profile is at least 30%, at least 35% or at least 40%, preferably at least 37%, C16:0. In some cases, the cell is a recombinant cell. In some embodiments, the recombinant cell comprises an exogenous gene encoding an acyl-ACP thioesterase protein that has hydrolysis activity towards fatty acyl-ACP substrates of chain length C16. In some embodiments, the recombinant cell comprises at least two exogenous genes encoding acyl-ACP thioesterase proteins from *Umbellularia californica* and *Cinnamomum camphora* that have hydrolysis activity towards fatty acyl-ACP substrates of chain length C16. In some cases, the cell is a *Prototheca* cell.

In a sixth aspect, the present invention provides oleaginous microbial cells, preferably microalgal cells, having a lipid profile that is at least 55% or at least 65%, preferably at least 60%, saturated fatty acids. In some cases the cells, have a lipid profile that is at least 80%, at least 85%, or at least 90%, preferably at least 86%, saturated fatty acids. In some cases, the cell is a recombinant cell. In some embodiments, the recombinant cell comprises an exogenous gene encoding an acyl-ACP thioesterase protein that has hydrolysis activity towards fatty acyl-ACP substrates of chain lengths C10-C16. In some embodiments, the cell comprises an exogenous gene encoding a ketoacyl synthase protein. In some cases, the cell is a *Prototheca* cell.

In a seventh aspect, the present invention provides oleaginous microbial cells, preferably microalgal cells, comprising a mutated endogenous desaturase gene, wherein the mutation renders the gene or desaturase inactive. In some cases, the cell has a lipid profile that is at least 40% or at least 50%, preferably at least 45%, saturated fatty acids. In some cases, the cell has a lipid profile that is at least 15%, at least 20% or at least 25%, preferably at least 19%, C18:0. In some embodiments, the cell comprises a mutated endogenous desaturase gene that results in at least a 2-fold increase in C18:0 fatty acid, as compared to a wild-type cell. In some cases, the microalgal cell has a lipid profile that is no more than 1% or no more than 5%, preferably no more than 2%, C18:2. In some embodiments, the microalgal cell has a lipid profile that is no more than 5% or no more than 10%, preferably no more than 7%, 18:1.

In some embodiments of the recombinant cells discussed herein, the cell comprises a mutated endogenous desaturase gene, wherein the mutation renders the gene or desaturase inactive.

In a eighth aspect, the present invention provides a method of making lipid. In one embodiment, the method comprises (a) cultivating a cell as discussed above until the cell is at least 15% or at least 25%, preferably at least 20%, lipid by dry weight, and (b) separating the lipid from water-soluble biomass components.

In a ninth aspect, the present invention provides another method of making lipid. In one embodiment, the method comprises (a) cultivating an oleaginous microbial, preferably a microalgae cell, containing exogenous genes encoding two distinct acyl-ACP thioesterases, wherein the lipid profile of the cell is distinct from (i) the profile of the cell without the exogenous genes and (ii) the profile of the cell with only one of the exogenous genes, and (b) separating the lipid from water-soluble biomass components. In some cases, at least one of the exogenous genes encodes a fatty acyl-ACP thioesterase selected from the group consisting of the thioesterases identified in Table 4.

In a tenth aspect, the present invention provides a method of making an oil-based product. In one embodiment, the method comprises (a) cultivating a cell as discussed above until the cell is at least 5% or at least 15%, preferably at least 10%, lipid by dry weight, (b) separating the lipid from water-soluble biomass components, and (c) subjecting the lipid to at least one chemical reaction selected from the group consisting of: saponification; metathesis; acid hydrolysis; alkaline hydrolysis; enzymatic hydrolysis; catalytic hydrolysis; hot-compressed water hydrolysis; a catalytic hydrolysis reaction wherein the lipid is split into glycerol and fatty acids; an amination reaction to produce fatty nitrogen compounds; an ozonolysis reaction to produce mono- and dibasic-acids; a triglyceride splitting reaction selected from the group consisting of enzymatic splitting and pressure splitting; a condensation reaction that follows a hydrolysis reaction; a hydroprocessing reaction; a hydroprocessing reaction and a deoxygenation reaction or a condensation reaction prior to or simultaneous with the hydroprocessing reaction; a gas removal reaction; a deoxygenation reaction selected from the group consisting of a hydrogenolysis reaction, hydrogenation, a consecutive hydrogenation-hydrogenolysis reaction, a consecutive hydrogenolysis-hydrogenation reaction, and a combined hydrogenation-hydrogenolysis reaction; a condensation reaction following a deoxygenation reaction; an esterification reaction; an interestification reaction; a transesterification reaction; a hydroxylation reaction; and a condensation reaction following a hydroxylation reaction, whereby an oil-based product is produced.

In some cases, the oil-based product is selected from soap or a fuel product. In some embodiments, the oil-based product is a fuel product selected from the group consisting biodiesel, renewable diesel, and jet fuel. In some cases, the fuel product is biodiesel with one or more of the following attributes: (i) 0.01-0.5 mcg/g, 0.025-0.3 mcg/g, preferably 0.05-0.244 mcg/g, total carotenoids; (ii) less than 0.01 mcg/g, less than 0.005 mcg/g, preferably less than 0.003 mcg/g, lycopene; (iii) less than 0.01 mcg/g, less than 0.005 mcg/g, preferably less than 0.003 mcg/g, beta carotene; (iv) 0.01-0.5 mcg/g, 0.025-0.3 mcg/g, preferably 0.045-0.268 mcg/g, chlorophyll A; (v) 1-500 mcg/g, 35-175 mcg/g, preferably 38.3-164 mcg/g, gamma tocopherol; (vi) less than 1%, less than 0.5%, preferably less than 0.25%, brassicasterol, campesterol, stignasterol, or beta-sitosterol; (vii) 100-500 mcg/g, 225-350 mcg/g, preferably 249.6-325.3 mcg/g, total tocotrienols; (viii) 0.001-0.1 mcg/g, 0.0025-0.05 mcg/g, preferably 0.003-0.039 mcg/g, lutein; or (ix) 10-500 mcg/g, 50-300 mcg/g, preferably 60.8-261.7 mcg/g, tocopherols. In some cases, the fuel product is renewable diesel that has a T10-T90 of at least 20° C., 40° C. or 60° C. In some cases, the fuel product is jet fuel that meets HRJ-5 and/or ASTM specification D1655.

In an eleventh aspect, the present invention provides a triglyceride oil comprising (a) a lipid profile of at least 3% C8:0, at least 4% C10:0, at least 13% C12:0, at least 10% C14:0, and/or at least 60% saturated fatty acids, and (b) one or more of the following attributes: (i) 0.01-0.5 mcg/g, 0.025-0.3 mcg/g, preferably 0.05-0.244 mcg/g, total carotenoids; (ii) less than 0.01 mcg/g, less than 0.005 mcg/g, preferably less than 0.003 mcg/g, lycopene; (iii) less than 0.01 mcg/g, less than 0.005 mcg/g, preferably less than 0.003 mcg/g, beta carotene; (iv) 0.01-0.5 mcg/g, 0.025-0.3 mcg/g, preferably 0.045-0.268 mcg/g, chlorophyll A; (v) 1-300 mcg/g, 35-175 mcg/g, preferably 38.3-164 mcg/g, gamma tocopherol; (vi) less than 1%, less than 0.5%, preferably less than 0.25%, brassicasterol, campesterol, stignasterol, or beta-sitosterol; (vii) 100-500 mcg/g, 225-350 mcg/g, preferably 249.6-325.3 mcg/g, total tocotrienols; (viii) 0.001-0.1 mcg/g, 0.0025-0.05 mcg/g, preferably 0.003-0.039 mcg/g, lutein; or (ix) 10-500 mcg/g, 50-300 mcg/g, preferably 60.8-261.7 mcg/g, tocopherols.

In a twelfth aspect, the present invention provides an isolated oil from microalgae that has a C8:C10 fatty acid ratio of at least 5:1. In a related aspect, the present invention provides an isolated oil from microalgae with at least 50% to 75%, preferably at least 60%, saturated fatty acids. In another related aspect, the present invention provides an isolated oil from microalgae that has a C16:14 fatty acid ratio of about 2:1. In still another related aspect, the present invention provides an isolated oil from microalgae that has a C12:C14 fatty acid ratio of at least 5:1. In some embodiments, the microalgae contains at least one exogenous gene. In some cases, the microalgae is of the genus *Prototheca*.

In a thirteenth aspect, the present invention provides a triglyceride oil comprising (a) a lipid profile of less than 5% or less than 2%, preferably less than 1%, <C12; between 1%-10%, preferably 2%-7%, C14:0; between 20%-35%, preferably 23%-30%, C16:0; between 5%-20%, preferably 7%-15%, C18:0; between 35-60%, preferably 40-55%, C18: 1; and between 1%-20%, preferably 2-15%, C18:2 fatty acids; and (b) one or more of the following attributes: (i) 0.01-0.5 mcg/g, 0.025-0.3 mcg/g, preferably 0.05-0.244 mcg/g, total carotenoids; (ii) less than 0.01 mcg/g, less than 0.005 mcg/g, preferably less than 0.003 mcg/g, lycopene; (iii) less than 0.01 mcg/g, less than 0.005 mcg/g, preferably less than 0.003 mcg/g, beta carotene; (iv) 0.01-0.5 mcg/g, 0.025-0.3 mcg/g, preferably 0.045-0.268 mcg/g, chlorophyll A; (v) 1-300 mcg/g, 35-175 mcg/g, preferably 38.3-164 mcg/g, gamma tocopherol; (vi) less than 1%, less than 0.5%, preferably less than 0.25%, brassicasterol, campesterol, stigmasterol, or beta-sitosterol; (vii) 100-500 mcg/g, 225-350 mcg/g, preferably 249.6-325.3 mcg/g, total tocotrienols; (viii) 0.001-0.1 mcg/g, 0.0025-0.05 mcg/g, preferably 0.003-0.039 mcg/g, lutein; or (ix) 10-500 mcg/g, 50-300, preferably 60.8-261.7 mcg/g, tocopherols.

In some cases, the triglyceride oil is isolated from a microbe comprising one or more exogenous gene. In some embodiments, the one or more exogenous gene encodes a fatty acyl-ACP thioesterase. In some cases, the fatty acyl-ACP thioesterase has hydrolysis activity towards fatty acyl-ACP substrates of chain length C14. In some embodiments, the microbe further comprises a mutated endogenous desaturase gene, wherein the mutation renders the gene or desaturase inactive.

In a fourteenth aspect, the present invention provides a method of producing a triglyceride oil comprising a lipid profile of less than 5%, or less than 2%, preferably less than 1%, <C12; between 1%-10%, preferably 2%-7%, C14:0; between 20%-35%, preferably 23%-30%, C16:0; between 5%-20%, preferably 7%-15%, C18:0; between 35%-60%, preferably 40-55%, C18:1; and between 1%-20%, preferably 2-15%, C18:2 fatty acids, wherein the triglyceride oil is isolated from a microbe comprising one or more exogenous gene. In some cases, the triglyceride oil comprises a lipid profile of 1%-10%, preferably 3-5%, C14:0; 20%-30%, preferably 25-27%, C16:0; 5%-20%, preferably 10-15%, C18:0; and 35%-50%, preferably 40-45%, C18:1. In some embodiments, the one or more exogenous gene encodes a fatty acyl-ACP thioesterase. In some cases, the fatty acyl-ACP thioesterase has hydrolysis activity towards fatty acyl-ACP substrates of chain length C14. In some cases, the microbe further comprises a mutated endogenous desaturase gene, wherein the mutation renders the gene or desaturase inactive. In some cases, the one or more exogenous gene is a sucrose invertase. In some embodiments, the mutated endogenous desaturase gene is a stearoyl-acyl carrier protein desaturase (SAD) (e.g., SEQ ID NOs: 199-200). In some embodiments, the mutated endogenous desaturase gene is a fatty acid desaturase (FAD).

In a fifteenth aspect, the present invention provides a oleaginous microbial cell, preferably a microalgal cell, comprising a triglyceride oil, wherein the fatty acid profile of the triglyceride oil is selected from the group consisting of at least about 1% C8:0, at least about 1% C10:0, at least about 1% C12:0, at least about 2% C14:0, at least about 30% C16:0, at least about 5% C18:0, at least about 60% C18:1, less than about 7% C18:2, and at least about 35% saturated fatty acids. In some cases, the oleaginous microbial cell comprises an exogenous gene, and optionally, an endogenous desaturase of the oleaginous microbial cell has been inactivated or mutated to have less enzymatic activity.

In some cases, the fatty acid profile of the triglyceride oil is similar to the fatty acid profile of a naturally occurring oil. In some cases, the naturally occurring oil is selected from the group consisting of cocoa butter, coconut oil, palm oil, palm kernel oil, shea butter, beef tallow and lard. In some cases, the fatty acid profile of the triglyceride oil comprises a profile selected from the group consisting of, the total combined amounts of C8:0 and C10:0 is at least about 10%, the total combined amount of C10:0, C12:0, and C14:0 is at least about 50%, the total combined amount of C16:0, C18:0 and C18:1 is at least about 60%, the total combined amount of C18:0, C18:1 and C18:2 is at least about 60%, the total combined amount of C14:0, C16:0, C18:0 and C18:1 is at least about 60%, and the total combined amount of C18:1 and C18:2 is less than about 30%. In some cases, the fatty acid profile of the triglyceride oil comprises a ratio of fatty acids selected from the group consisting of C8:0 to C10:0 ratio of at least about 5 to 1, C10:0 to C12:0 ratio of at least about 6 to 1, C12:0 to C14:0 ratio of at least about 5 to 1, C14:0 to C12:0 ratio of at least about 7:1, and C14:0 to C16:0 ratio of at least about 1 to 2.

In some cases, the endogenous desaturase is selected from the group consisting of stearoyl ACP desaturase and delta 12 fatty acid desaturase. In some cases, the exogenous gene is selected from the group consisting of a gene encoding an acyl-ACP thioesterase. In some cases, the exogenous gene encodes an acyl-ACP thioesterase selected from the group consisting of those identified in Table 4. In some cases, the oleaginous microbial cell further comprises a gene encoding a sucrose invertase.

In various embodiments, the oleaginous microbial cell is a cell of a microalgal genus or species selected from *Achnanthes orientalis, Agmenellum, Amphiprora hyaline, Amphora coffeiformis, Amphora coffeiformis linea, Amphora coffeiformis punctata, Amphora coffeiformis taylori, Amphora coffeiformis tenuis, Amphora delicatissima, Amphora delicatissima capitata, Amphora* sp., *Anabaena, Ankistrodesmus, Ankistrodesmus falcatus, Boekelovia hooglandii, Borodinella* sp., *Botryococcus braunii, Botryococcus sudeticus, Carteria, Chaetoceros gracilis, Chaetoceros muelleri, Chaetoceros muelleri subsalsum, Chaetoceros* sp., *Chlorella anitrata, Chlorella Antarctica, Chlorella aureoviridis, Chlorella candida, Chlorella capsulate, Chlorella desiccate, Chlorella ellipsoidea, Chlorella emersonii, Chlorella fusca, Chlorella fusca* var. *vacuolate, Chlorella glucotropha, Chlorella infusionum, Chlorella infusionum* var. *actophila, Chlorella infusionum* var. *auxenophila, Chlorella kessleri, Chlorella lobophora* (strain SAG 37.88), *Chlorella luteoviridis, Chlorella luteoviridis* var. *aureoviridis, Chlorella luteoviridis* var. *lutescens, Chlorella miniata, Chlorella minutissima, Chlorella mutabilis, Chlorella nocturna, Chlorella parva, Chlorella photophila, Chlorella pringsheimii, Chlorella protothecoides* (including any of UTEX strains 1806, 411, 264, 256, 255, 250, 249, 31, 29, 25, and CCAP strains 211/17 and 211/8d), *Chlorella protothecoides* var. *acidicola, Chlorella regularis, Chlorella regularis* var. *minima, Chlorella regularis* var. *umbricata, Chlorella reisiglii, Chlorella saccharophila, Chlorella saccharophila* var. *ellipsoidea, Chlorella salina,*

*Chlorella simplex, Chlorella sorokiniana, Chlorella* sp., *Chlorella sphaerica, Chlorella stigmatophora, Chlorella vanniellii, Chlorella vulgaris, Chlorella vulgaris, Chlorella vulgaris* f. *tertia, Chlorella vulgaris* var. *autotrophica, Chlorella vulgaris* var. *viridis, Chlorella vulgaris* var. *vulgaris, Chlorella vulgaris* var. *vulgaris* f. *tertia, Chlorella vulgaris* var. *vulgaris* f. *viridis, Chlorella xanthella, Chlorella zofingiensis, Chlorella trebouxioides, Chlorella vulgaris, Chlorococcum infusionum, Chlorococcum* sp., *Chlorogonium, Chroomonas* sp., *Chrysosphaera* sp., *Cricosphaera* sp., *Cryptomonas* sp., *Cyclotella cryptica, Cyclotella meneghiniana, Cyclotella* sp., *Dunaliella* sp., *Dunaliella bardawil, Dunaliella bioculata, Dunaliella granulate, Dunaliella maritime, Dunaliella minuta, Dunaliella parva, Dunaliella peircei, Dunaliella primolecta, Dunaliella salina, Dunaliella terricola, Dunaliella tertiolecta, Dunaliella viridis, Dunaliella tertiolecta, Eremosphaera viridis, Eremosphaera* sp., *Ellipsoidon* sp., *Euglena, Franceia* sp., *Fragilaria crotonensis, Fragilaria* sp., *Gleocapsa* sp., *Gloeothamnion* sp., *Hymenomonas* sp., *Isochrysis* aff. *galbana, Isochrysis galbana, Lepocinclis, Micractinium, Micractinium* (UTEX LB 2614), *Monoraphidium minutum, Monoraphidium* sp., *Nannochloris* sp., *Nannochloropsis salina, Nannochloropsis* sp., *Navicula acceptata, Navicula biskanterae, Navicula pseudotenelloides, Navicula pelliculosa, Navicula saprophila, Navicula* sp., *Nephrochloris* sp., *Nephroselmis* sp., *Nitschia communis, Nitzschia alexandrina, Nitzschia communis, Nitzschia dissipata, Nitzschia frustulum, Nitzschia hantzschiana, Nitzschia inconspicua, Nitzschia intermedia, Nitzschia microcephala, Nitzschia pusilla, Nitzschia pusilla elliptica, Nitzschia pusilla monoensis, Nitzschia quadrangular, Nitzschia* sp., *Ochromonas* sp., *Oocystis parva, Oocystis pusilla, Oocystis* sp., *Oscillatoria limnetica, Oscillatoria* sp., *Oscillatoria subbrevis, Pascheria acidophila, Pavlova* sp., *Phagus, Phormidium, Platymonas* sp., *Pleurochrysis carterae, Pleurochrysis dentate, Pleurochrysis* sp., *Prototheca wickerhamii, Prototheca stagnora, Prototheca portoricensis, Prototheca moriformis, Prototheca zopfii, Pyramimonas* sp., *Pyrobotrys, Sarcinoid chrysophyte, Scenedesmus armatus, Spirogyra, Spirulina platensis, Stichococcus* sp., *Synechococcus* sp., *Tetraedron, Tetraselmis* sp., *Tetraselmis suecica, Thalassiosira weissflogii,* and *Viridiella fridericiana.*

In some cases, the oleaginous microbial cell is a cell of the genus *Prototheca*. In some cases, the oleaginous microbial cell is a cell of the genus *Prototheca moriformis*.

In some cases, the oleaginous microbial cell is an oleaginous yeast cell. In some cases, the oleaginous microbial cell is an oleaginous bacterial cell.

In some cases, the naturally occurring oil is cocoa butter and the exogenous gene comprises a *Carthamus tinctorus* thioesterase gene. In some cases, the naturally occurring oil is coconut oil. In some cases, the naturally occurring oil is palm oil and the exogenous gene comprises a *Elaeis guiniensis* thioesterase gene, a *Cuphea hookeriana* thioesterase gene, a combination of a *Cuphea hookeriana* KAS IV gene and a *Cuphea wrightii* FATB2 gene, or a construct designed to disrupt an endogenous KAS II gene. In some cases, the naturally occurring oil is palm kernel oil and the exogenous gene comprises a combination of a *Cuphea wrightii* FATB2 gene and a construct designed to disrupt an endogenous SAD2B gene. In some cases, the naturally occurring oil is shea butter. In some cases, the naturally occurring oil is beef tallow. In some cases, the naturally occurring oil is lard and the exogenous gene comprises a combination of *U. californica* thioesterase gene and a construct designed to disrupt an endogenous SAD2B gene, a combination of a *Garcinia mangostana* thioesterase gene and a construct designed to disrupt an endogenous SAD2B gene, a *Brassica napus* thioesterase gene, or a *Cuphea hookeriana* thioesterase gene.

In a sixteenth aspect, the present invention provides an oleaginous microbial triglyceride oil composition, wherein the fatty acid profile of the triglyceride oil is selected from the group consisting of at least about 1% C8:0, at least about 1% C10:0, at least about 1% C12:0, at least about 2% C14:0, at least about 30% C16:0, at least about 5% C18:0, at least about 60% C18:1, less than about 7% C18:2, and at least about 35% saturated fatty acids. In various embodiments, the triglyceride oil composition is produced by cultivating a population of oleaginous microbial cells or recombinant oleaginous microbial cells in a culture medium, wherein the oleaginous microbial cells are as described above, in particular those described above in connection with the fifteenth aspect of the invention.

In some cases, the oleaginous microbial triglyceride oil composition further comprises an attribute selected from the group consisting of: (i) less than 0.3 mcg/g total carotenoids; (ii) less than 0.005 mcg/g lycopene; (iii) less than 0.005 mcg/g beta carotene; (iv) less than 0.3 mcg/g chlorophyll A; (v) less than 175 mcg/g gamma tocopherol; (vi) less than 0.25% brassicasterol, campesterol, stignasterol, or beta-sitosterol; (vii) less than 350 mcg/g total tocotrienols; (viii) less than 0.05 mcg/g lutein; or (ix) less than 275 mcg/g tocopherols.

In a seventeenth aspect, the present invention provides a method of producing an oleaginous microbial triglyceride oil composition having a fatty acid profile selected from the group consisting of at least about 1% C8:0, at least about 1% C10:0, at least about 1% C12:0, at least about 2% C14:0, at least about 30% C16:0, at least about 5% C18:0, at least about 60% C18:1, less than about 7% C18:2, and at least about 35% saturated fatty acids, wherein the method comprises the steps of: (a) cultivating a population of oleaginous microbial cells in a culture medium until at least 10% of the dry cell weight of the oleaginous microbial cells is triglyceride oil; and (b) isolating the triglyceride oil composition from the oleaginous microbial cells. In various embodiments, the triglyceride oil composition is produced via cultivation of a population of oleaginous microbial cells or recombinant oleaginous microbial cells as described above, in particular those described above in connection with the fifteenth aspect of the invention.

In an eighteenth aspect, the present invention provides a method of making an oil-based product, wherein the method comprises the steps of: (a) subjecting the oleaginous microbial triglyceride oil composition, as described above in connection with the sixteenth aspect of the invention, to at least one chemical reaction selected from the group consisting of: saponification; metathesis; acid hydrolysis; alkaline hydrolysis; enzymatic hydrolysis; catalytic hydrolysis; hot-compressed water hydrolysis; a catalytic hydrolysis reaction wherein the lipid is split into glycerol and fatty acids; an amination reaction to produce fatty nitrogen compounds; an ozonolysis reaction to produce mono- and dibasic-acids; a triglyceride splitting reaction selected from the group consisting of enzymatic splitting and pressure splitting; a condensation reaction that follows a hydrolysis reaction; a hydroprocessing reaction; a hydroprocessing reaction and a deoxygenation reaction or a condensation reaction prior to or simultaneous with the hydroprocessing reaction; a gas removal reaction; a deoxygenation reaction selected from the group consisting of a hydrogenolysis reaction, hydrogenation, a consecutive hydrogenation-hydrogenolysis reaction, a consecutive hydrogenolysis-hydrogenation reaction, and a combined hydrogenation-hydrogenolysis reaction; a condensation reaction following a deoxygenation reaction; an esterification reaction; an interestification reaction; a transesterification reaction; a hydroxylation reaction; and a condensation reaction following a hydroxylation reaction; and (b) isolating the product of the reaction from the other components.

In some cases, the oil-based product is selected from the group consisting of a soap, a fuel, a dielectric fluid, a hydraulic fluid, a plasticizer, a lubricant, a heat transfer fluid, and a metal working fluid. In some cases, the oil-based product is a fuel product selected from the group consisting of: (a) biodiesel; (b) renewable diesel; and (c) jet fuel.

In some cases, the fuel product is biodiesel with one or more of the following attributes: (i) less than 0.3 mcg/g total carotenoids; (ii) less than 0.005 mcg/g lycopene; (iii) less than 0.005 mcg/g beta carotene; (iv) less than 0.3 mcg/g chlorophyll A; (v) less than 175 mcg/g gamma tocopherol; (vi) less than 0.25% brassicasterol, campesterol, stignasterol, or beta-sitosterol; (vii) less than 350 mcg/g total tocotrienols; (viii) less than 0.05 mcg/g lutein; or (ix) less than 275 mcg/g tocopherols.

In some cases, the fuel product is renewable diesel that has a T10-T90 of at least 20° C., 40° C. or 60° C.

In some cases, the fuel product is jet fuel that meets HRJ-5 and/or ASTM specification D1655.

These and other aspects and embodiments of the invention are described in the accompanying drawing, a brief description of which immediately follows, the detailed description of the invention below, and are exemplified in the examples below. Any or all of the features discussed above and throughout the application can be combined in various embodiments of the present invention.

BRIEF DESCRIPTION OF THE DRAWINGS

FIG. 1 shows a chromatogram of renewable diesel produced from *Prototheca* triglyceride oil.

DETAILED DESCRIPTION OF THE INVENTION

The present invention arises from the discovery that *Prototheca* and certain related microorganisms have unexpectedly advantageous properties for the production of oils, fuels, and other hydrocarbon or lipid compositions economically and in large quantities, as well as from the discovery of methods and reagents for genetically altering these microorganisms to improve these properties. The oils produced by these microorganisms can be used in the transportation fuel, oleochemical, and/or food and cosmetic industries, among other applications. Transesterification of lipids yields long-chain fatty acid esters useful as biodiesel. Other enzymatic and chemical processes can be tailored to yield fatty acids, aldehydes, alcohols, alkanes, and alkenes. In some applications, renewable diesel, jet fuel, or other hydrocarbon compounds are produced. The present invention also provides methods of cultivating microalgae for increased productivity and increased lipid yield, and/or for more cost-effective production of the compositions described herein.

This detailed description of the invention is divided into sections for the convenience of the reader. Section I provides definitions of terms used herein. Section II provides a description of culture conditions useful in the methods of the invention. Section III provides a description of genetic engineering methods and materials. Section IV provides a description of genetic engineering of microorganisms (e.g., *Prototheca*) to enable sucrose utilization. Section V provides a description of genetic engineering of microorganisms (e.g., *Prototheca*) to modify lipid biosynthesis. Section VI describes methods for making fuels and chemicals. Section VII discloses examples and embodiments of the invention. The detailed description of the invention is followed by examples that illustrate the various aspects and embodiments of the invention.

I. Definitions

Unless defined otherwise, all technical and scientific terms used herein have the meaning commonly understood by a person skilled in the art to which this invention belongs. The following references provide one of skill with a general definition of many of the terms used in this invention: Singleton et al., *Dictionary of Microbiology and Molecular Biology* (2nd ed. 1994); *The Cambridge Dictionary of Science and Technology* (Walker ed., 1988); *The Glossary of Genetics*, 5th Ed., R. Rieger et al. (eds.), Springer Verlag (1991); and Hale & Marham, *The Harper Collins Dictionary of Biology* (1991). As used herein, the following terms have the meanings ascribed to them unless specified otherwise.

"Active in microalgae" refers to a nucleic acid that is functional in microalgae. For example, a promoter that has been used to drive an antibiotic resistance gene to impart antibiotic resistance to a transgenic microalgae is active in microalgae.

"Acyl carrier protein" or "ACP" is a protein that binds a growing acyl chain during fatty acid synthesis as a thiol ester at the distal thiol of the 4'-phosphopantetheine moiety and comprises a component of the fatty acid synthase complex.

"Acyl-CoA molecule" or "acyl-CoA" is a molecule comprising an acyl moiety covalently attached to coenzyme A through a thiol ester linkage at the distal thiol of the 4'-phosphopantetheine moiety of coenzyme A.

"Area Percent" refers to the area of peaks observed using FAME GC/FID detection methods in which every fatty acid in the sample is converted into a fatty acid methyl ester (FAME) prior to detection. For example, a separate peak is observed for a fatty acid of 14 carbon atoms with no unsaturation (C14:0) compared to any other fatty acid such as C14:1. The peak area for each class of FAME is directly proportional to its percent composition in the mixture and is calculated based on the sum of all peaks present in the sample (i.e. [area under specific peak/total area of all measured peaks]×100). When referring to lipid profiles of oils and cells of the invention, "at least 4% C8-C14" means that at least 4% of the total fatty acids in the cell or in the extracted glycerolipid composition have a chain length that includes 8, 10, 12 or 14 carbon atoms.

"Axenic" is a culture of an organism free from contamination by other living organisms.

"Biodiesel" is a biologically produced fatty acid alkyl ester suitable for use as a fuel in a diesel engine.

"Biomass" is material produced by growth and/or propagation of cells. Biomass may contain cells and/or intracellular contents as well as extracellular material, includes, but is not limited to, compounds secreted by a cell.

"Bioreactor" is an enclosure or partial enclosure in which cells are cultured, optionally in suspension.

"Catalyst" is an agent, such as a molecule or macromolecular complex, capable of facilitating or promoting a chemical reaction of a reactant to a product without becoming a part of the product. A catalyst increases the rate of a reaction, after which, the catalyst may act on another reactant to form the product. A catalyst generally lowers the overall activation energy required for the reaction such that it proceeds more quickly or at a lower temperature. Thus, a reaction equilibrium may be more quickly attained. Examples of catalysts include enzymes, which are biological catalysts; heat, which is a non-biological catalyst; and metals used in fossil oil refining processes.

"Cellulosic material" is the product of digestion of cellulose, including glucose and xylose, and optionally additional compounds such as disaccharides, oligosaccharides, lignin, furfurals and other compounds. Nonlimiting examples of sources of cellulosic material include sugar cane bagasses, sugar beet pulp, corn stover, wood chips, sawdust and switchgrass.

"Co-culture", and variants thereof such as "co-cultivate" and "co-ferment", refer to the presence of two or more types of cells in the same bioreactor. The two or more types of cells may both be microorganisms, such as microalgae, or may be a microalgal cell cultured with a different cell type. The culture conditions may be those that foster growth and/or propagation of the two or more cell types or those that facilitate growth and/or proliferation of one, or a subset, of the two or more cells while maintaining cellular growth for the remainder.

"Cofactor" is any molecule, other than the substrate, required for an enzyme to carry out its enzymatic activity.

"Complementary DNA" or "cDNA" is a DNA copy of mRNA, usually obtained by reverse transcription of messenger RNA (mRNA) or amplification (e.g., via polymerase chain reaction ("PCR")).

"Cultivated", and variants thereof such as "cultured" and "fermented", refer to the intentional fostering of growth (increases in cell size, cellular contents, and/or cellular activity) and/or propagation (increases in cell numbers via mitosis) of one or more cells by use of selected and/or controlled conditions. The combination of both growth and propagation may be termed proliferation. Examples of selected and/or controlled conditions include the use of a defined medium (with known characteristics such as pH, ionic strength, and carbon source), specified temperature, oxygen tension, carbon dioxide levels, and growth in a bioreactor. Cultivate does not refer to the growth or propagation of microorganisms in nature or otherwise without human intervention; for example, natural growth of an organism that ultimately becomes fossilized to produce geological crude oil is not cultivation.

"Cytolysis" is the lysis of cells in a hypotonic environment. Cytolysis is caused by excessive osmosis, or movement of water, towards the inside of a cell (hyperhydration). The cell cannot withstand the osmotic pressure of the water inside, and so it explodes.

"Delipidated meal" and "delipidated microbial biomass" is microbial biomass after oil (including lipids) has been extracted or isolated from it, either through the use of mechanical (i.e., exerted by an expeller press) or solvent extraction or both. Delipidated meal has a reduced amount of oil/lipids as compared to before the extraction or isolation of oil/lipids from the microbial biomass but does contain some residual oil/lipid.

"Expression vector" or "expression construct" or "plasmid" or "recombinant DNA construct" refer to a nucleic acid that has been generated via human intervention, including by recombinant means or direct chemical synthesis, with a series of specified nucleic acid elements that permit transcription and/or translation of a particular nucleic acid in a host cell. The expression vector can be part of a plasmid, virus, or nucleic acid fragment. Typically, the expression vector includes a nucleic acid to be transcribed operably linked to a promoter.

"Exogenous gene" is a nucleic acid that codes for the expression of an RNA and/or protein that has been introduced ("transformed") into a cell. A transformed cell may be referred to as a recombinant cell, into which additional exogenous gene(s) may be introduced. The exogenous gene may be from a different species (and so heterologous), or from the same species (and so homologous), relative to the cell being transformed. Thus, an exogenous gene can include a homologous gene that occupies a different location in the genome of the cell or is under different control, relative to the endogenous copy of the gene. An exogenous gene may be present in more than one copy in the cell. An exogenous gene may be maintained in a cell as an insertion into the genome or as an episomal molecule.

"Exogenously provided" refers to a molecule provided to the culture media of a cell culture.

"Expeller pressing" is a mechanical method for extracting oil from raw materials such as soybeans and rapeseed. An expeller press is a screw type machine, which presses material through a caged barrel-like cavity. Raw materials enter one side of the press and spent cake exits the other side while oil seeps out between the bars in the cage and is collected. The machine uses friction and continuous pressure from the screw drives to move and compress the raw material. The oil seeps through small openings that do not allow solids to pass through. As the raw material is pressed, friction typically causes it to heat up.

"Fatty acyl-ACP thioesterase" is an enzyme that catalyzes the cleavage of a fatty acid from an acyl carrier protein (ACP) during lipid synthesis.

"Fatty acyl-CoA/aldehyde reductase" is an enzyme that catalyzes the reduction of an acyl-CoA molecule to a primary alcohol.

"Fatty acyl-CoA reductase" is an enzyme that catalyzes the reduction of an acyl-CoA molecule to an aldehyde.

"Fatty aldehyde decarbonylase" is an enzyme that catalyzes the conversion of a fatty aldehyde to an alkane.

"Fatty aldehyde reductase" is an enzyme that catalyzes the reduction of an aldehyde to a primary alcohol.

"Fixed carbon source" is a molecule(s) containing carbon, typically an organic molecule, that is present at ambient temperature and pressure in solid or liquid form in a culture media that can be utilized by a microorganism cultured therein.

"Homogenate" is biomass that has been physically disrupted.

"Hydrocarbon" is (a) a molecule containing only hydrogen and carbon atoms wherein the carbon atoms are covalently linked to form a linear, branched, cyclic, or partially cyclic backbone to which the hydrogen atoms are attached. The molecular structure of hydrocarbon compounds varies from the simplest, in the form of methane ($CH_4$), which is a constituent of natural gas, to the very heavy and very complex, such as some molecules such as asphaltenes found in crude oil, petroleum, and bitumens. Hydrocarbons may be in gaseous, liquid, or solid form, or any combination of these forms, and may have one or more double or triple bonds between adjacent carbon atoms in the backbone. Accordingly, the term includes linear, branched, cyclic, or partially cyclic alkanes, alkenes, lipids, and paraffin. Examples include propane, butane, pentane, hexane, octane, and squalene.

"Hydrogen:carbon ratio" is the ratio of hydrogen atoms to carbon atoms in a molecule on an atom-to-atom basis. The ratio may be used to refer to the number of carbon and hydrogen atoms in a hydrocarbon molecule. For example, the hydrocarbon with the highest ratio is methane $CH_4$ (4:1).

"Hydrophobic fraction" is the portion, or fraction, of a material that is more soluble in a hydrophobic phase in comparison to an aqueous phase. A hydrophobic fraction is substantially insoluble in water and usually non-polar.

"Increase lipid yield" refers to an increase in the productivity of a microbial culture by, for example, increasing dry weight of cells per liter of culture, increasing the percentage of cells that constitute lipid, or increasing the overall amount of lipid per liter of culture volume per unit time.

"Inducible promoter" is a promoter that mediates transcription of an operably linked gene in response to a particular stimulus. Examples of such promoters may be promoter sequences that are induced in conditions of changing pH or nitrogen levels.

"In operable linkage" is a functional linkage between two nucleic acid sequences, such a control sequence (typically a promoter) and the linked sequence (typically a sequence that encodes a protein, also called a coding sequence). A promoter is in operable linkage with an exogenous gene if it can mediate transcription of the gene.

"In situ" means "in place" or "in its original position".

"Limiting concentration of a nutrient" is a concentration of a compound in a culture that limits the propagation of a cultured organism. A "non-limiting concentration of a nutrient" is a concentration that supports maximal propagation during a given culture period. Thus, the number of cells produced during a given culture period is lower in the presence of a limiting concentration of a nutrient than when the nutrient is non-limiting. A nutrient is said to be "in excess" in a culture, when the nutrient is present at a concentration greater than that which supports maximal propagation.

"Lipase" is a water-soluble enzyme that catalyzes the hydrolysis of ester bonds in water-insoluble, lipid substrates. Lipases catalyze the hydrolysis of lipids into glycerols and fatty acids.

"Lipid modification enzyme" refers to an enzyme that alters the covalent structure of a lipid. Examples of lipid modification enzymes include a lipase, a fatty acyl-ACP thioesterase, a fatty acyl-CoA/aldehyde reductase, a fatty acyl-CoA reductase, a fatty aldehyde reductase, a desaturase, including a stearoyl acyl carrier protein desaturase (SAD) and a fatty acyl desaturase (FAD), and a fatty aldehyde decarbonylase.

"Lipid pathway enzyme" is any enzyme that plays a role in lipid metabolism, i.e., either lipid synthesis, modification, or degradation, and any proteins that chemically modify lipids, as well as carrier proteins.

"Lipids" are a class of molecules that are soluble in nonpolar solvents (such as ether and chloroform) and are relatively or completely insoluble in water. Lipid molecules have these properties, because they consist largely of long hydrocarbon tails which are hydrophobic in nature. Examples of lipids include fatty acids (saturated and unsaturated); glycerides or glycerolipids (such as monoglycerides, diglycerides, triglycerides or neutral fats, and phosphoglycerides or glycerophospholipids); nonglycerides (sphingolipids, sterol lipids including cholesterol and steroid hormones, prenol lipids including terpenoids, fatty alcohols, waxes, and polyketides); and complex lipid derivatives (sugar-linked lipids, or glycolipids, and protein-linked lipids). "Fats" are a subgroup of lipids called "triacylglycerides."

"Lysate" is a solution containing the contents of lysed cells.

"Lysis" is the breakage of the plasma membrane and optionally the cell wall of a biological organism sufficient to release at least some intracellular content, often by mechanical, viral or osmotic mechanisms that compromise its integrity.

"Lysing" is disrupting the cellular membrane and optionally the cell wall of a biological organism or cell sufficient to release at least some intracellular content.

"Microalgae" is a eukaryotic microbial organism that contains a chloroplast or plastid, and optionally that is capable of performing photosynthesis, or a prokaryotic microbial organism capable of performing photosynthesis. Microalgae include obligate photoautotrophs, which cannot metabolize a fixed carbon source as energy, as well as heterotrophs, which can live solely off of a fixed carbon source. Microalgae include unicellular organisms that separate from sister cells shortly after cell division, such as *Chlamydomonas*, as well as microbes such as, for example, *Volvox*, which is a simple multicellular photosynthetic microbe of two distinct cell types. Microalgae include cells such as *Chlorella*, *Dunaliella*, and *Prototheca*. Microalgae also include other microbial photosynthetic organisms that exhibit cell-cell adhesion, such as *Agmenellum*, *Anabaena*, and *Pyrobotrys*. Microalgae also include obligate heterotrophic microorganisms that have lost the ability to perform photosynthesis, such as certain dinoflagellate algae species and species of the genus *Prototheca*.

"Microorganism" and "microbe" are microscopic unicellular organisms.

"Naturally co-expressed" with reference to two proteins or genes means that the proteins or their genes are co-expressed naturally in a tissue or organism from which they are derived, e.g., because the genes encoding the two proteins are under the control of a common regulatory sequence or because they are expressed in response to the same stimulus.

"Osmotic shock" is the rupture of cells in a solution following a sudden reduction in osmotic pressure. Osmotic shock is sometimes induced to release cellular components of such cells into a solution.

"Polysaccharide-degrading enzyme" is any enzyme capable of catalyzing the hydrolysis, or saccharification, of any polysaccharide. For example, cellulases catalyze the hydrolysis of cellulose.

"Polysaccharides" or "glycans" are carbohydrates made up of monosaccharides joined together by glycosidic linkages. Cellulose is a polysaccharide that makes up certain plant cell walls. Cellulose can be depolymerized by enzymes to yield monosaccharides such as xylose and glucose, as well as larger disaccharides and oligosaccharides.

"Promoter" is a nucleic acid control sequence that directs transcription of a nucleic acid. As used herein, a promoter includes necessary nucleic acid sequences near the start site of transcription, such as, in the case of a polymerase II type promoter, a TATA element. A promoter also optionally includes distal enhancer or repressor elements, which can be located as much as several thousand base pairs from the start site of transcription.

"Recombinant" is a cell, nucleic acid, protein or vector, that has been modified due to the introduction of an exogenous nucleic acid or the alteration of a native nucleic acid. Thus, e.g., recombinant cells express genes that are not found within the native (non-recombinant) form of the cell or express native genes differently than those genes are expressed by a non-recombinant cell. A "recombinant nucleic acid" is a nucleic acid originally formed in vitro, in general, by the manipulation of nucleic acid, e.g., using polymerases and endonucleases, or otherwise is in a form not normally found in nature. Recombinant nucleic acids may be produced, for example, to place two or more nucleic acids in operable linkage. Thus, an isolated nucleic acid or an expression vector formed in vitro by ligating DNA molecules that are not normally joined in nature, are both considered recombinant for the purposes of this invention. Once a recombinant nucleic acid is made and introduced into a host cell or organism, it may replicate using the in vivo cellular machinery of the host cell; however, such nucleic acids, once produced recombinantly, although subsequently replicated intracellularly, are still considered recombinant for purposes of this invention.

Similarly, a "recombinant protein" is a protein made using recombinant techniques, i.e., through the expression of a recombinant nucleic acid.

"Renewable diesel" is a mixture of alkanes (such as C10:0, C12:0, C14:0, C16:0 and C18:0) produced through hydrogenation and deoxygenation of lipids.

"Saccharification" is a process of converting biomass, usually cellulosic or lignocellulosic biomass, into monomeric sugars, such as glucose and xylose. "Saccharified" or "depolymerized" cellulosic material or biomass refers to cellulosic material or biomass that has been converted into monomeric sugars through saccharification.

The term "similar," when used in the context of a comparison to a naturally occurring oil, without further qualification, means that the oil being compared to the naturally occurring oil contains about +/−15%, or +/−10% of the top two triglycerides of the naturally occurring oil. For example, Shea butter (the oil of *B. Parkii*) contains 41.2-56.8% C18:0 and 34.0-46.9% C18:1 as the two most common triglyceride components (see Table 5). A "similar" oil that is within +/−10% would contain from about 37% to about 62% C18:0 and from 31% to about 52% C18:1 as the two most common triglyceride components. When used in this context, the term "similar" includes +/−9%, +/−8%, +/−7%, +/−6%, +/−5%, +/−4%, +/−3%, +/−2%, or +/−1%, and can further represent a comparison to the top three or top four triglycerides of the naturally occurring oil, or two out of the top three triglycerides, or three out of the top four triglycerides.

"Sonication" is a process of disrupting biological materials, such as a cell, by use of sound wave energy.

"Species of furfural" is 2-furancarboxaldehyde or a derivative that retains the same basic structural characteristics.

"Stover" is the dried stalks and leaves of a crop remaining after a grain has been harvested.

"Sucrose utilization gene" is a gene that, when expressed, aids the ability of a cell to utilize sucrose as an energy source. Proteins encoded by a sucrose utilization gene are referred to herein as "sucrose utilization enzymes" and include sucrose transporters, sucrose invertases, and hexokinases such as glucokinases and fructokinases.

II. Cultivation

The present invention generally relates to cultivation of microorganisms (e.g., microalgae, oleaginous yeast, fungi, and bacteria), particularly recombinant microalgal strains, including *Prototheca* strains, for the production of lipid. For the convenience of the reader, this section is subdivided into subsections. Subsection 1 describes *Prototheca* species and strains and how to identify new *Prototheca* species and strains and related microalgae by genomic DNA comparison, as well as other microorganisms. Subsection 2 describes bioreactors useful for cultivation. Subsection 3 describes media for cultivation. Subsection 4 describes oil production in accordance with illustrative cultivation methods of the invention. These descriptions are also more generally applicable to other microorganisms.

1. *Prototheca* Species and Strains and Other Microorganisms

*Prototheca* is a remarkable microorganism for use in the production of lipid, because it can produce high levels of lipid, particularly lipid suitable for fuel production. The lipid produced by *Prototheca* has hydrocarbon chains of shorter chain length and a higher degree of saturation than that produced by other microalgae. Moreover, *Prototheca* lipid is generally free of pigment (low to undetectable levels of chlorophyll and certain carotenoids) and in any event contains much less pigment than lipid from other microalgae. Moreover, recombinant *Prototheca* cells provided by the invention can be used to produce lipid in greater yield and efficiency, and with reduced cost, relative to the production of lipid from other microorganisms. Illustrative *Prototheca* strains for use in the methods of the invention include In addition, this microalgae grows heterotrophically and can be genetically engineered as *Prototheca wickerhamii*, *Prototheca stagnora* (including UTEX 327), *Prototheca portoricensis*, *Prototheca moriformis* (including UTEX strains 1441, 1435), and *Prototheca zopfii*. Species of the genus *Prototheca* are obligate heterotrophs.

Species of *Prototheca* for use in the invention can be identified by amplification of certain target regions of the genome. For example, identification of a specific *Prototheca* species or strain can be achieved through amplification and sequencing of nuclear and/or chloroplast DNA using primers and methodology using any region of the genome, for example using the methods described in Wu et al., *Bot. Bull. Acad. Sin.* (2001) 42:115-121 Identification of *Chlorella* spp. isolates using ribosomal DNA sequences. Well established methods of phylogenetic analysis, such as amplification and sequencing of ribosomal internal transcribed spacer (ITS1 and ITS2 rDNA), 23S rRNA, 18S rRNA, and other conserved genomic regions can be used by those skilled in the art to identify species of not only *Prototheca*, but other hydrocarbon and lipid producing organisms with similar lipid profiles and production capability. For examples of methods of identification and classification of algae also see for example *Genetics*, 2005 August; 170(4):1601-10 and RNA, 2005 April; 11(4): 361-4.

Thus, genomic DNA comparison can be used to identify suitable species of microalgae to be used in the present invention. Regions of conserved genomic DNA, such as but not limited to DNA encoding for 23S rRNA, can be amplified from microalgal species and compared to consensus sequences in order to screen for microalgal species that are taxonomically related to the preferred microalgae used in the present invention. Examples of such DNA sequence comparison for species within the *Prototheca* genus are shown below. Genomic DNA comparison can also be useful to identify microalgal species that have been misidentified in a strain collection. Often a strain collection will identify species of microalgae based on phenotypic and morphological characteristics. The use of these characteristics may lead to miscategorization of the species or the genus of a microalgae. The use of genomic DNA comparison can be a better method of categorizing microalgae species based on their phylogenetic relationship.

Microalgae for use in the present invention typically have genomic DNA sequences encoding for 23S rRNA that have at least 99%, least 95%, at least 90%, or at least 85% nucleotide identity to at least one of the sequences listed in SEQ ID NOs: 11-19.

For sequence comparison to determine percent nucleotide or amino acid identity, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally Ausubel et al., supra).

Another example algorithm that is suitable for determining percent sequence identity and sequence similarity is the BLAST algorithm, which is described in Altschul et al., *J. Mol. Biol.* 215:403-410 (1990). Software for performing BLAST analyses is publicly available through the National Center for Biotechnology Information (at the web address www.ncbi.nlm.nih.gov). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra.). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below due to the accumulation of one or more negative-scoring residue alignments; or the end of either sequence is reached. For identifying whether a nucleic acid or polypeptide is within the scope of the invention, the default parameters of the BLAST programs are suitable. The BLASTN program (for nucleotide sequences) uses as defaults a word length (W) of 11, an expectation (E) of 10, M=5, N=−4, and a comparison of both strands. For amino acid sequences, the BLASTP program uses as defaults a word length (W) of 3, an expectation (E) of 10, and the BLOSUM62 scoring matrix. The TBLATN program (using protein sequence for nucleotide sequence) uses as defaults a word length (W) of 3, an expectation (E) of 10, and a BLOSUM 62 scoring matrix. (see Henikoff & Henikoff, *Proc. Natl. Acad. Sci. USA* 89:10915 (1989)).

In addition to calculating percent sequence identity, the BLAST algorithm also performs a statistical analysis of the similarity between two sequences (see, e.g., Karlin & Altschul, *Proc. Nat'l. Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

Other considerations affecting the selection of microorganisms for use in the invention include, in addition to production of suitable lipids or hydrocarbons for production of oils, fuels, and oleochemicals: (1) high lipid content as a percentage of cell weight; (2) ease of growth; (3) ease of genetic engineering; and (4) ease of biomass processing. In particular embodiments, the wild-type or genetically engineered microorganism yields cells that are at least 40%, at least 45%, at least 50%, at least 55%, at least 60%, at least 65%, or at least 70% or more lipid. Preferred organisms grow heterotrophically (on sugars in the absence of light).

Examples of algae that can be used to practice the present invention include, but are not limited to the following algae listed in Table 1.

TABLE 1

Examples of algae.

*Achnanthes orientalis, Agmenellum, Amphiprora hyaline, Amphora coffeiformis, Amphora coffeiformis linea, Amphora coffeiformis punctata, Amphora coffeiformis taylori, Amphora coffeiformis tenuis, Amphora delicatissima, Amphora delicatissima capitata, Amphora* sp., *Anabaena, Ankistrodesmus, Ankistrodesmus falcatus, Boekelovia hooglandii, Borodinella* sp., *Botryococcus braunii, Botryococcus sudeticus, Carteria, Chaetoceros gracilis, Chaetoceros muelleri, Chaetoceros muelleri subsalsum, Chaetoceros* sp., *Chlorella anitrata, Chlorella Antarctica, Chlorella aureoviridis, Chlorella candida, Chlorella capsulate, Chlorella desiccate, Chlorella ellipsoidea, Chlorella emersonii, Chlorella fusca, Chlorella fusca* var. *vacuolata, Chlorella glucotropha, Chlorella infusionum, Chlorella infusionum* var. *actophila, Chlorella infusionum* var. *auxenophila, Chlorella kessleri, Chlorella lobophora* (strain SAG 37.88), *Chlorella luteoviridis, Chlorella luteoviridis* var. *aureoviridis, Chlorella luteoviridis* var. *lutescens, Chlorella miniata, Chlorella minutissima, Chlorella mutabilis, Chlorella nocturna, Chlorella parva, Chlorella photophila, Chlorella pringsheimii, Chlorella prototheocoides* (including any of UTEX strains 1806, 411, 264, 256, 255, 250, 249, 31, 29, 25, and CCAP strains 211/17 and 211/8d), *Chlorella prototheocoides* var. *acidicola, Chlorella regularis, Chlorella regularis* var. *minima, Chlorella regularis* var. *umbricata, Chlorella reisiglii, Chlorella saccharophila, Chlorella saccharophila* var. *ellipsoidea, Chlorella salina, Chlorella simplex, Chlorella sorokiniana, Chlorella* sp., *Chlorella sphaerica, Chlorella stigmatophora, Chlorella vanniellii, Chlorella vulgaris, Chlorella vulgaris, Chlorella vulgaris f. tertia, Chlorella vulgaris* var. *autotrophica, Chlorella vulgaris* var. *viridis, Chlorella vulgaris* var. *vulgaris, Chlorella vulgaris* var. *vulgaris f. tertia, Chlorella vulgaris* var. *vulgaris f. viridis, Chlorella xanthella, Chlorella zofingiensis, Chlorella trebouxioides, Chlorella vulgaris, Chlorococcum infusionum, Chlorococcum* sp., *Chlorogonium, Chroomonas* sp., *Chrysosphaera* sp., *Cricosphaera* sp., *Cryptomonas* sp., *Cyclotella cryptica, Cyclotella meneghiniana, Cyclotella* sp., *Dunaliella* sp., *Dunaliella bardawil, Dunaliella bioculata, Dunaliella granulate, Dunaliella maritime, Dunaliella minuta, Dunaliella parva, Dunaliella peircei, Dunaliella primolecta, Dunaliella salina, Dunaliella terricola, Dunaliella tertiolecta, Dunaliella viridis, Dunaliella tertiolecta, Eremosphaera viridis, Eremosphaera* sp., *Ellipsoidon* sp., *Euglena, Franceia* sp., *Fragilaria crotonensis, Fragilaria* sp., *Gleocapsa* sp., *Gleothamnion* sp., *Hymenomonas* sp., *Isochrysis aff. galbana, Isochrysis galbana,*

TABLE 1-continued

Examples of algae.

*Lepocinclis, Micractinium, Micractinium* (UTEX LB 2614), *Monoraphidium minutum, Monoraphidium* sp., *Nannochloris* sp., *Nannochloropsis salina, Nannochloropsis* sp., *Navicula acceptata, Navicula biskanterae, Navicula pseudotenelloides, Navicula pelliculosa, Navicula saprophila, Navicula* sp., *Nephrochloris* sp., *Nephroselmis* sp., *Nitschia communis, Nitzschia alexandrina, Nitzschia communis, Nitzschia dissipata, Nitzschia frustulum, Nitzschia hantzschiana, Nitzschia inconspicua, Nitzschia intermedia, Nitzschia microcephala, Nitzschia pusilla, Nitzschia pusilla elliptica, Nitzschia pusilla monoensis, Nitzschia quadrangular, Nitzschia* sp., *Ochromonas* sp., *Oocystis parva, Oocystis pusilla, Oocystis* sp., *Oscillatoria limnetica, Oscillatoria* sp., *Oscillatoria subbrevis, Pascheria acidophila, Pavlova* sp., *Phagus, Phormidium, Platymonas* sp., *Pleurochrysis carterae, Pleurochrysis dentate, Pleurochrysis* sp., *Prototheca wickerhamii, Prototheca stagnora, Prototheca portoricensis, Prototheca moriformis, Prototheca zopfii, Pyramimonas* sp., *Pyrobotrys, Sarcinoid chrysophyte, Scenedesmus armatus, Spirogyra, Spirulina platensis, Stichococcus* sp., *Synechococcus* sp., *Tetraedron, Tetraselmis* sp., *Tetraselmis suecica, Thalassiosira weissflogii*, and *Viridiella fridericiana*

Examples of oleaginous yeast that can be used to practice the present invention include, but are not limited to the following oleaginous yeast listed in Table 1A.

TABLE 1A

Examples of oleaginous yeast.

*Cryptococcus curvatus, Cryptococcus terricolus, Candida* sp., *Lipomyces starkeyi, Lipomyces lipofer, Endomycopsis vernalis, Rhodotorula glutinis, Rhodotorula gracilis,* and *Yarrowia lipolytica*

Examples of other fungi that can be used to practice the present invention include, but are not limited to the following fungi listed in Table 1B.

TABLE 1B

Examples of fungi.

*Mortierella, Mortierrla vinacea, Mortierella alpine, Pythium debaryanum, Mucor circinelloides, Aspergillus ochraceus, Aspergillus terreus, Pennicillium iilacinum, Hensenulo, Chaetomium, Cladosporium, Malbranchea, Rhizopus,* and *Pythium*

In some embodiments of the present invention, the microorganism is a bacterium. Examples of expression of exogenous genes in bacteria, such as *E. coli*, are well known; see for example *Molecular Cloning: A Laboratory Manual*, Sambrook et al. (3d edition, 2001, Cold Spring Harbor Press).

2. Bioreactor

Microrganisms are cultured both for purposes of conducting genetic manipulations and for production of hydrocarbons (e.g., lipids, fatty acids, aldehydes, alcohols, and alkanes). The former type of culture is conducted on a small scale and initially, at least, under conditions in which the starting microorganism can grow. Culture for purposes of hydrocarbon production is usually conducted on a large scale (e.g., 10,000 L, 40,000 L, 100,000 L or larger bioreactors) in a bioreactor. Microalgae, including *Prototheca* species are typically cultured in the methods of the invention in liquid media within a bioreactor. Typically, the bioreactor does not allow light to enter.

The bioreactor or fermentor is used to culture oleaginous microbial cells, preferably microalgal cells through the various phases of their physiological cycle. Bioreactors offer many advantages for use in heterotrophic growth and propagation methods. To produce biomass for use in food, microalgae are preferably fermented in large quantities in liquid, such as in suspension cultures as an example. Bioreactors such as steel fermentors can accommodate very large culture volumes (40,000 liter and greater capacity bioreactors are used in various embodiments of the invention). Bioreactors also typically allow for the control of culture conditions such as temperature, pH, oxygen tension, and carbon dioxide levels. For example, bioreactors are typically configurable, for example, using ports attached to tubing, to allow gaseous components, like oxygen or nitrogen, to be bubbled through a liquid culture. Other culture parameters, such as the pH of the culture media, the identity and concentration of trace elements, and other media constituents can also be more readily manipulated using a bioreactor.

Bioreactors can be configured to flow culture media though the bioreactor throughout the time period during which the microalgae reproduce and increase in number. In some embodiments, for example, media can be infused into the bioreactor after inoculation but before the cells reach a desired density. In other instances, a bioreactor is filled with culture media at the beginning of a culture, and no more culture media is infused after the culture is inoculated. In other words, the microalgal biomass is cultured in an aqueous medium for a period of time during which the microalgae reproduce and increase in number; however, quantities of aqueous culture medium are not flowed through the bioreactor throughout the time period. Thus in some embodiments, aqueous culture medium is not flowed through the bioreactor after inoculation.

Bioreactors equipped with devices such as spinning blades and impellers, rocking mechanisms, stir bars, means for pressurized gas infusion can be used to subject microalgal cultures to mixing. Mixing may be continuous or intermittent. For example, in some embodiments, a turbulent flow regime of gas entry and media entry is not maintained for reproduction of microalgae until a desired increase in number of said microalgae has been achieved.

Bioreactor ports can be used to introduce, or extract, gases, solids, semisolids, and liquids, into the bioreactor chamber containing the microalgae. While many bioreactors have more than one port (for example, one for media entry, and another for sampling), it is not necessary that only one substance enter or leave a port. For example, a port can be used to flow culture media into the bioreactor and later used for sampling, gas entry, gas exit, or other purposes. Preferably, a sampling port can be used repeatedly without altering compromising the axenic nature of the culture. A sampling port can be configured with a valve or other device that allows the flow of sample to be stopped and started or to provide a means of continuous sampling. Bioreactors typically have at least one port that allows inoculation of a culture, and such a port can also be used for other purposes such as media or gas entry.

Bioreactors ports allow the gas content of the culture of microalgae to be manipulated. To illustrate, part of the volume of a bioreactor can be gas rather than liquid, and the gas inlets of the bioreactor to allow pumping of gases into the bioreactor. Gases that can be beneficially pumped into a bioreactor include air, air/$CO_2$ mixtures, noble gases, such as argon, and other gases. Bioreactors are typically equipped to enable the user to control the rate of entry of a gas into the bioreactor. As noted above, increasing gas flow into a bioreactor can be used to increase mixing of the culture.

Increased gas flow affects the turbidity of the culture as well. Turbulence can be achieved by placing a gas entry port below the level of the aqueous culture media so that gas entering the bioreactor bubbles to the surface of the culture. One or more gas exit ports allow gas to escape, thereby preventing pressure buildup in the bioreactor. Preferably a gas exit port leads to a "one-way" valve that prevents contaminating microorganisms from entering the bioreactor.

3. Media

Microalgal culture media typically contains components such as a fixed nitrogen source, a fixed carbon source, trace elements, optionally a buffer for pH maintenance, and phosphate (typically provided as a phosphate salt). Other components can include salts such as sodium chloride, particularly for seawater microalgae. Nitrogen sources include organic and inorganic nitrogen sources, including, for example, without limitation, molecular nitrogen, nitrate, nitrate salts, ammonia (pure or in salt form, such as, $(NH_4)_2SO_4$ and $NH_4OH$), protein, soybean meal, cornsteep liquor, and yeast extract. Examples of trace elements include zinc, boron, cobalt, copper, manganese, and molybdenum in, for example, the respective forms of $ZnCl_2$, $H_3BO_3$, $CoCl_2.6H_2O$, $CuCl_2.2H_2O$, $MnCl_2.4H_2O$ and $(NH_4)_6MO_7O_{24}.4H_2O$.

Microorganisms useful in accordance with the methods of the present invention are found in various locations and environments throughout the world. As a consequence of their isolation from other species and their resulting evolutionary divergence, the particular growth medium for optimal growth and generation of lipid and/or hydrocarbon constituents can be difficult to predict. In some cases, certain strains of microorganisms may be unable to grow on a particular growth medium because of the presence of some inhibitory component or the absence of some essential nutritional requirement required by the particular strain of microorganism.

Solid and liquid growth media are generally available from a wide variety of sources, and instructions for the preparation of particular media that is suitable for a wide variety of strains of microorganisms can be found, for example, online at http://www.utex.org/, a site maintained by the University of Texas at Austin, 1 University Station A6700, Austin, Tex., 78712-0183, for its culture collection of algae (UTEX). For example, various fresh water and salt water media include those described in PCT Pub. No. 2008/151149, incorporated herein by reference.

In a particular example, Protease Medium is suitable for axenic cultures, and a 1 L volume of the medium (pH ~6.8) can be prepared by addition of 1 g of protease peptone to 1 liter of Bristol Medium. Bristol medium comprises 2.94 mM $NaNO_3$, 0.17 mM $CaCl_2.2H_2O$, 0.3 mM $MgSO_4.7H_2O$, 0.43 mM, 1.29 mM $KH_2PO_4$, and 1.43 mM NaCl in an aqueous solution. For 1.5% agar medium, 15 g of agar can be added to 1 L of the solution. The solution is covered and autoclaved, and then stored at a refrigerated temperature prior to use. Another example is the *Prototheca* isolation medium (PIM), which comprises 10 g/L potassium hydrogen phthalate (KHP), 0.9 g/L sodium hydroxide, 0.1 g/L magnesium sulfate, 0.2 g/L potassium hydrogen phosphate, 0.3 g/L ammonium chloride, 10 g/L glucose 0.001 g/L thiamine hydrochloride, 20 g/L agar, 0.25 g/L 5-fluorocytosine, at a pH in the range of 5.0 to 5.2 (see Pore, 1973, App. Microbiology, 26: 648-649). Other suitable media for use with the methods of the invention can be readily identified by consulting the URL identified above, or by consulting other organizations that maintain cultures of microorganisms, such as SAG, CCAP, or CCALA. SAG refers to the Culture Collection of Algae at the University of Göttingen (Göttingen, Germany), CCAP refers to the culture collection of algae and protozoa managed by the Scottish Association for Marine Science (Scotland, United Kingdom), and CCALA refers to the culture collection of algal laboratory at the Institute of Botany (Třeboň, Czech Republic). Additionally, U.S. Pat. No. 5,900,370 describes media formulations and conditions suitable for heterotrophic fermentation of *Prototheca* species.

For oil production, selection of a fixed carbon source is important, as the cost of the fixed carbon source must be sufficiently low to make oil production economical. Thus, while suitable carbon sources include, for example, acetate, floridoside, fructose, galactose, glucuronic acid, glucose, glycerol, lactose, mannose, N-acetylglucosamine, rhamnose, sucrose, and/or xylose, selection of feedstocks containing those compounds is an important aspect of the methods of the invention. Suitable feedstocks useful in accordance with the methods of the invention include, for example, black liquor, corn starch, depolymerized cellulosic material, milk whey, molasses, potato, sorghum, sucrose, sugar beet, sugar cane, rice, and wheat. Carbon sources can also be provided as a mixture, such as a mixture of sucrose and depolymerized sugar beet pulp. The one or more carbon source(s) can be supplied at a concentration of at least about 50 μM, at least about 100 μM, at least about 500 μM, at least about 5 mM, at least about 50 mM, and at least about 500 mM, of one or more exogenously provided fixed carbon source(s). Carbon sources of particular interest for purposes of the present invention include cellulose (in a depolymerized form), glycerol, sucrose, and sorghum, each of which is discussed in more detail below.

In accordance with the present invention, microorganisms can be cultured using depolymerized cellulosic biomass as a feedstock. Cellulosic biomass (e.g., stover, such as corn stover) is inexpensive and readily available; however, attempts to use this material as a feedstock for yeast have failed. In particular, such feedstocks have been found to be inhibitory to yeast growth, and yeast cannot use the 5-carbon sugars produced from cellulosic materials (e.g., xylose from hemi-cellulose). By contrast, microalgae can grow on processed cellulosic material. Cellulosic materials generally include about 40-60% cellulose; about 20-40% hemicellulose; and 10-30% lignin.

Suitable cellulosic materials include residues from herbaceous and woody energy crops, as well as agricultural crops, i.e., the plant parts, primarily stalks and leaves, not removed from the fields with the primary food or fiber product. Examples include agricultural wastes such as sugarcane bagasse, rice hulls, corn fiber (including stalks, leaves, husks, and cobs), wheat straw, rice straw, sugar beet pulp, citrus pulp, citrus peels; forestry wastes such as hardwood and softwood thinnings, and hardwood and softwood residues from timber operations; wood wastes such as saw mill wastes (wood chips, sawdust) and pulp mill waste; urban wastes such as paper fractions of municipal solid waste, urban wood waste and urban green waste such as municipal grass clippings; and wood construction waste. Additional cellulosics include dedicated cellulosic crops such as switchgrass, hybrid poplar wood, and miscanthus, fiber cane, and fiber sorghum. Five-carbon sugars that are produced from such materials include xylose.

Cellulosic materials are treated to increase the efficiency with which the microbe can utilize the sugar(s) contained within the materials. The invention provides novel methods for the treatment of cellulosic materials after acid explosion so that the materials are suitable for use in a heterotrophic culture of microbes (e.g., microalgae and oleaginous yeast). As discussed above, lignocellulosic biomass is comprised of various fractions, including cellulose, a crystalline polymer of beta 1,4 linked glucose (a six-carbon sugar), hemicellulose, a more loosely associated polymer predominantly comprised of xylose (a five-carbon sugar) and to a lesser extent mannose, galactose, arabinose, lignin, a complex aromatic polymer comprised of sinapyl alcohol and its derivatives, and pectins, which are linear chains of an alpha 1,4 linked polygalacturonic acid. Because of the polymeric structure of cellulose and hemicellulose, the sugars (e.g., monomeric glucose and xylose) in them are not in a form that can be efficiently used (metabolized) by many microbes. For such microbes, further processing of the cellulosic biomass to generate the monomeric sugars that make up the polymers can be very helpful to ensuring that the cellulosic materials are efficiently utilized as a feedstock (carbon source).

Celluose or cellulosic biomass is subjected to a process, termed "explosion", in which the biomass is treated with dilute sulfuric (or other) acid at elevated temperature and pressure. This process conditions the biomass such that it can be efficiently subjected to enzymatic hydrolysis of the cellulosic and hemicellulosic fractions into glucose and xylose monomers. The resulting monomeric sugars are termed cellulosic sugars. Cellulosic sugars can subsequently be utilized by microorganisms to produce a variety of metabolites (e.g., lipid). The acid explosion step results in a partial hydrolysis of the hemicellulose fraction to constitutent monosaccharides. These sugars can be completely liberated from the biomass with further treatment. In some embodiments, the further treatment is a hydrothermal treatment that includes washing the exploded material with hot water, which removes contaminants such as salts. This step is not necessary for cellulosic ethanol fermentations due to the more dilute sugar concentrations used in such processes. In other embodiments, the further treatment is additional acid treatment. In still other embodiments, the further treatment is enzymatic hydrolysis of the exploded material. These treatments can also be used in any combination. The type of treatment can affect the type of sugars liberated (e.g., five carbon sugars versus six carbon sugars) and the stage at which they are liberated in the process. As a consequence, different streams of sugars, whether they are predominantly five-carbon or six-carbon, can be created. These enriched five-carbon or six-carbon streams can thus be directed to specific microorganisms with different carbon utilization cabilities.

The methods of the present invention typically involve fermentation to higher cell densities than what is achieved in ethanol fermentation. Because of the higher densities of the cultures for heterotrophic cellulosic oil production, the fixed carbon source (e.g., the cellulosic derived sugar stream(s)) is preferably in a concentrated form. The glucose level of the depolymerized cellulosic material is preferably at least 300 g/liter, at least 400 g/liter, at least 500 g/liter or at least 600 g/liter prior to the cultivation step, which is optionally a fed batch cultivation in which the material is fed to the cells over time as the cells grow and accumulate lipid. Cellulosic sugar streams are not used at or near this concentration range in the production of cellulosic ethanol. Thus, in order to generate and sustain the very high cell densities during the production of lignocellulosic oil, the carbon feedstock(s) must be delivered into the heterotrophic cultures in a highly concentrated form. However, any component in the feedstream that is not a substrate for, and is not metabolized by, the oleaginous microorganism will accumulate in the bioreactor, which can lead to problems if the component is toxic or inhibitory to production of the desired end product. While ligin and lignin-derived by-products, carbohydrate-derived byproducts such as furfurals and hydroxymethyl furfurals and salts derived from the generation of the cellulosic materials (both in the explosion process and the subsequent neutralization process), and even non-metabolized pentose/hexose sugars can present problems in ethanolic fermentations, these effects are amplified significantly in a process in which their concentration in the initial feedstock is high. To achieve sugar concentrations in the 300 g/L range (or higher) for six-carbon sugars that may be used in large scale production of lignocellulosic oil described in the present invention, the concentration of these toxic materials can be 20 times higher than the concentrations typically present in ethanolic fermentations of cellulosic biomass.

The explosion process treatment of the cellulosic material utilizes significant amounts of sulfuric acid, heat and pressure, thereby liberating by-products of carbohydrates, namely furfurals and hydroxymethyl furfurals. Furfurals and hydroxymethyl furfurals are produced during hydrolysis of hemicellulose through dehydration of xylose into furfural and water. In some embodiments of the present invention, these by-products (e.g., furfurals and hydroxymethyl furfurals) are removed from the saccharified lignocellulosic material prior to introduction into the bioreactor. In certain embodiments of the present invention, the process for removal of the by-products of carbohydrates is hydrothermal treatment of the exploded cellulosic materials. In addition, the present invention provides methods in which strains capable of tolerating compounds such as furfurals or hydroxymethyl furfurals are used for lignocellulosic oil production. In another embodiment, the present invention also provides methods and microorganisms that are not only capable of tolerating furfurals in the fermentation media, but are actually able to metabolize these by-products during the production of lignocellulosic oil.

The explosion process also generates significant levels of salts. For example, typical conditions for explosion can result in conductivites in excess of 5 mS/cm when the exploded cellulosic biomass is resuspended at a ratio of 10:1 water:solids (dry weight). In certain embodiments of the present invention, the diluted exploded biomass is subjected to enzymatic saccharification, and the resulting supernatant is concentrated up to 25 fold for use in the bioreactor. The salt level (as measured by conductivity) in the concentrated sugar stream(s) can be unacceptably high (up to 1.5 M $Na^+$ equivalents). Additional salts are generated upon neutralization of the exploded materials for the subsequent enzymatic saccharification process as well. The present invention provides methods for removing these salts so that the resulting concentrated cellulosic sugar stream(s) can be used in heterotrophic processes for producing lignocellulosic oil. In some embodiments, the method of removing these salts is deionization with resins, such as, but not limited to, DOWEX Marathon MR3. In certain embodiments, the deionization with resin step occurs before sugar concentration or pH adjustment and hydrothermal treatment of biomass prior to saccharification, or any combination of the preceding; in other embodiments, the step is conducted after one or more of these processes. In other embodiments, the explosion process itself is changed so as to avoid the generation of salts at unacceptably high levels. For example, a suitable alternative to sulfuric acid (or other acid) explosion of the cellulosic biomass is mechanical pulping to render the cellulosic biomass receptive to enzymatic hydrolysis (saccharification). In still other embodiments, native strains of microorganisms resistant to high levels of salts or genetically engineered strains with resistance to high levels of salts are used.

A preferred embodiment for the process of preparing of exploded cellulosic biomass for use in heterotrophic lignocellulosic oil production using oleaginous microbes. A first step comprises adjusting the pH of the resuspended exploded cellulosic biomass to the range of 5.0-5.3 followed by washing the cellulosic biomass three times. This washing step can be accomplished by a variety of means including the use of desalting and ion exchange resins, reverse omosis, hydrothermal treatment (as described above), or just repeated re-suspension and centrifugation in deionized water. This wash step results in a cellulosic stream whose conductivity is between 100-300 µS/cm and the removal of significant amounts of furfurals and hydroxymethyl furfurals. Decants from this wash step can be saved to concentrate five-carbon sugars liberated from the hemicellulose fraction. A second step comprises enzymatic saccharification of the washed cellulosic biomass. In a preferred embodiment, Accellerase (Genencor) is used. A third step comprises the recovery of sugars via centrifugation or decanting and rinsing of the saccharified biomass. The resulting biomass (solids) is an energy dense, lignin rich component that can be used as fuel or sent to waste. The recovered sugar stream in the centrifugation/decanting and rinse process is collected. A fourth step comprises microfiltration to remove contaminating solids with recovery of the permeate. A fifth step comprises a concentration step which can be accomplished using a vacuum evaporator. This step can optionally include the addition of antifoam agents such as P'2000 (Sigma/Fluka), which is sometimes necessary due to the protein content of the resulting sugar feedstock.

In another embodiment of the methods of the invention, the carbon source is glycerol, including acidulated and non-acidulated glycerol byproduct from biodiesel transesterification. In one embodiment, the carbon source includes glycerol and at least one other carbon source. In some cases, all of the glycerol and the at least one other fixed carbon source are provided to the microorganism at the beginning of the fermentation. In some cases, the glycerol and the at least one other fixed carbon source are provided to the microorganism simultaneously at a predetermined ratio. In some cases, the glycerol and the at least one other fixed carbon source are fed to the microbes at a predetermined rate over the course of fermentation.

Some microalgae undergo cell division faster in the presence of glycerol than in the presence of glucose (see PCT Pub. No. 2008/151149). In these instances, two-stage growth processes in which cells are first fed glycerol to rapidly increase cell density, and are then fed glucose to accumulate lipids can improve the efficiency with which lipids are produced. The use of the glycerol byproduct of the transesterification process provides significant economic advantages when put back into the production process. Other feeding methods are provided as well, such as mixtures of glycerol and glucose. Feeding such mixtures also captures the same economic benefits. In addition, the invention provides methods of feeding alternative sugars to microalgae such as sucrose in various combinations with glycerol.

In another embodiment of the methods of the invention, the carbon source is invert sugar. Invert sugar is produced by splitting the sucrose into its monosaccharide components, fructose and glucose. Production of invert sugar can be achieved through several methods that are known in the art. One such method is heating an aqueous solution of sucrose. Often, catalysts are employed in order to accelerate the conversion of sucrose into invert sugar. These catalysts can be biological, for example enzymes such as invertases and sucrases can be added to the sucrose to accelerate the hydrolysis reaction to produce invert sugar. Acid is an example of non-biological catalyst, when paired with heat, can accelerate the hydrolysis reaction. Once the invert sugar is made, it is less prone to crystallization compared to sucrose and thus, provides advantages for storage and in fed batch fermentation, which in the case of heterotrophic cultivation of microbes, including microalgae, there is a need for concentrated carbon source. In one embodiment, the carbon source is invert sugar, preferably in a concentrated form, preferably at least 800 g/liter, at least 900 g/liter, at least 1000 g/liter or at least 1100 g/liter prior to the cultivation step, which is optionally a fed batch cultivation. The invert sugar, preferably in a concentrated form, is fed to the cells over time as the cells grow and accumulate lipid.

In another embodiment of the methods of the invention, the carbon source is sucrose, including a complex feedstock containing sucrose, such as thick cane juice from sugar cane processing. Because of the higher densities of the cultures for heterotrophic oil production, the fixed carbon source (e.g., sucrose, glucose, etc.) is preferably in a concentrated form, preferably at least 500 g/liter, at least 600 g/liter, at least 700 g/liter or at least 800 g/liter of the fixed carbon source prior to the cultivation step, which is optionally a fed batch cultivation in which the material is fed to the cells over time as the cells grow and accumulate lipid. In the some cases, the carbon source is sucrose in the form of thick cane juice, preferably in a concentrated form, preferably at least 60% solids or about 770 g/liter sugar, at least 70% solids or about 925 g/liter sugar, or at least 80% solids or about 1125 g/liter sugar prior to the cultivation step, which is optionally a fed batch cultivation. The concentrated thick cane juice is fed to the cells over time as the cells grow and accumulate lipid.

In one embodiment, the culture medium further includes at least one sucrose utilization enzyme. In some cases, the culture medium includes a sucrose invertase. In one embodiment, the sucrose invertase enzyme is a secreatable sucrose invertase enzyme encoded by an exogenous sucrose invertase gene expressed by the population of microorganisms. Thus, in some cases, as described in more detail in Section IV, below, the microalgae has been genetically engineered to express a sucrose utilization enzyme, such as a sucrose transporter, a sucrose invertase, a hexokinase, a glucokinase, or a fructokinase.

Complex feedstocks containing sucrose include waste molasses from sugar cane processing; the use of this low-value waste product of sugar cane processing can provide significant cost savings in the production of hydrocarbons and other oils. Another complex feedstock containing sucrose that is useful in the methods of the invention is sorghum, including sorghum syrup and pure sorghum. *Sorghum* syrup is produced from the juice of sweet sorghum cane. Its sugar profile consists of mainly glucose (dextrose), fructose and sucrose.

4. Oil Production

For the production of oil in accordance with the methods of the invention, it is preferable to culture cells in the dark, as is the case, for example, when using extremely large (40,000 liter and higher) fermentors that do not allow light to strike the culture. *Prototheca* species are grown and propagated for the production of oil in a medium containing a fixed carbon source and in the absence of light; such growth is known as heterotrophic growth.

As an example, an inoculum of lipid-producing oleaginous microbial cells, preferably microalgal cells are introduced into the medium; there is a lag period (lag phase) before the cells begin to propagate. Following the lag period, the propagation rate increases steadily and enters the log, or exponential, phase. The exponential phase is in turn followed by a slowing of propagation due to decreases in nutrients such as nitrogen, increases in toxic substances, and quorum sensing mechanisms. After this slowing, propagation stops, and the cells enter a stationary phase or steady growth state, depending on the particular environment provided to the cells. For obtaining lipid rich biomass, the culture is typically harvested well after then end of the exponential phase, which may be terminated early by allowing nitrogen or another key nutrient (other than carbon) to become depleted, forcing the cells to convert the carbon sources, present in excess, to lipid. Culture condition parameters can be manipulated to optimize total oil production, the combination of lipid species produced, and/or production of a specific oil.

As discussed above, a bioreactor or fermentor is used to allow cells to undergo the various phases of their growth cycle. As an example, an inoculum of lipid-producing cells can be introduced into a medium followed by a lag period (lag phase) before the cells begin growth. Following the lag period, the growth rate increases steadily and enters the log, or exponential, phase. The exponential phase is in turn followed by a slowing of growth due to decreases in nutrients and/or increases in toxic substances. After this slowing, growth stops, and the cells enter a stationary phase or steady state, depending on the particular environment provided to the cells. Lipid production by cells disclosed herein can occur during the log phase or thereafter, including the stationary phase wherein nutrients are supplied, or still available, to allow the continuation of lipid production in the absence of cell division.

Preferably, microorganisms grown using conditions described herein and known in the art comprise at least about 20% by weight of lipid, preferably at least about 40% by weight, more preferably at least about 50% by weight, and most preferably at least about 60% by weight. Process conditions can be adjusted to increase the yield of lipids suitable for a particular use and/or to reduce production cost. For example, in certain embodiments, a microalgae is cultured in the presence of a limiting concentration of one or more nutrients, such as, for example, nitrogen, phosphorous, or sulfur, while providing an excess of fixed carbon energy such as glucose. Nitrogen limitation tends to increase microbial lipid yield over microbial lipid yield in a culture in which nitrogen is provided in excess. In particular embodiments, the increase in lipid yield is at least about: 10%, 50%, 100%, 200%, or 500%. The microbe can be cultured in the presence of a limiting amount of a nutrient for a portion of the total culture period or for the entire period. In particular embodiments, the nutrient concentration is cycled between a limiting concentration and a non-limiting concentration at least twice during the total culture period. Lipid content of cells can be increased by continuing the culture for increased periods of time while providing an excess of carbon, but limiting or no nitrogen.

In another embodiment, lipid yield is increased by culturing a lipid-producing microbe (e.g., microalgae) in the presence of one or more cofactor(s) for a lipid pathway enzyme (e.g., a fatty acid synthetic enzyme). Generally, the concentration of the cofactor(s) is sufficient to increase microbial lipid (e.g., fatty acid) yield over microbial lipid yield in the absence of the cofactor(s). In a particular embodiment, the cofactor(s) are provided to the culture by including in the culture a microbe (e.g., microalgae) containing an exogenous gene encoding the cofactor(s). Alternatively, cofactor(s) may be provided to a culture by including a microbe (e.g., microalgae) containing an exogenous gene that encodes a protein that participates in the synthesis of the cofactor. In certain embodiments, suitable cofactors include any vitamin required by a lipid pathway enzyme, such as, for example: biotin, pantothenate. Genes encoding cofactors suitable for use in the invention or that participate in the synthesis of such cofactors are well known and can be introduced into microbes (e.g., microalgae), using contructs and techniques such as those described above.

The specific examples of bioreactors, culture conditions, and heterotrophic growth and propagation methods described herein can be combined in any suitable manner to improve efficiencies of microbial growth and lipid and/or protein production.

Microalgal biomass with a high percentage of oil/lipid accumulation by dry weight has been generated using different methods of culture, which are known in the art (see PCT Pub. No. 2008/151149). Microalgal biomass generated by the culture methods described herein and useful in accordance with the present invention comprises at least 10% microalgal oil by dry weight. In some embodiments, the microalgal biomass comprises at least 25%, at least 50%, at least 55%, or at least 60% microalgal oil by dry weight. In some embodiments, the microalgal biomass contains from 10-90% microalgal oil, from 25-75% microalgal oil, from 40-75% microalgal oil, or from 50-70% microalgal oil by dry weight.

The microalgal oil of the biomass described herein, or extracted from the biomass for use in the methods and compositions of the present invention can comprise glycerolipids with one or more distinct fatty acid ester side chains. Glycerolipids are comprised of a glycerol molecule esterified to one, two or three fatty acid molecules, which can be of varying lengths and have varying degrees of saturation. The length and saturation characteristics of the fatty acid molecules (and the microalgal oils) can be manipulated to modify the properties or proportions of the fatty acid molecules in the microalgal oils of the present invention via culture conditions or via lipid pathway engineering, as described in more detail in Section IV, below. Thus, specific blends of algal oil can be prepared either within a single species of algae by mixing together the biomass or algal oil from two or more species of microalgae, or by blending algal oil of the invention with oils from other sources such as soy, rapeseed, canola, palm, palm kernel, coconut, corn, waste vegetable, Chinese tallow, olive, sunflower, cottonseed, chicken fat, beef tallow, porcine tallow, microalgae, macroalgae, microbes, *Cuphea*, flax, peanut, choice white grease, lard, Camelina sativa, mustard seed, cashew nut, oats, lupine, kenaf, *calendula*, help, coffee, linseed (flax), hazelnut, *euphorbia*, pumpkin seed, coriander, camellia, sesame, safflower, rice, tung tree, cocoa, copra, pium poppy, castor beans, pecan, jojoba, *macadamia*, Brazil nuts, avocado, petroleum, or a distillate fraction of any of the preceding oils.

The oil composition, i.e., the properties and proportions of the fatty acid consitutents of the glycerolipids, can also be manipulated by combining biomass or oil from at least two distinct species of microalgae. In some embodiments, at least two of the distinct species of microalgae have different glycerolipid profiles. The distinct species of microalgae can be cultured together or separately as described herein, preferably under heterotrophic conditions, to generate the respective oils. Different species of microalgae can contain different percentages of distinct fatty acid consituents in the cell's glycerolipids.

Generally, *Prototheca* strains have very little or no fatty acids with the chain length C8-C14. For example, *Prototheca moriformis* (UTEX 1435), *Prototheca krugani* (UTEX 329), *Prototheca stagnora* (UTEX 1442) and *Prototheca zopfii* (UTEX 1438) contains no (or undectable amounts) C8 fatty acids, between 0-0.01% C10 fatty acids, between 0.03-2.1% C12 fatty acids and between 1.0-1.7% C14 fatty acids.

In some cases, the *Prototheca* strains containing a transgene encoding a fatty acyl-ACP thioesterase that has activity towards fatty acyl-ACP substrate of chain lengths C8 or C8-10 has at least 1%, at least 1.5%, at least 2%, at least 3%, at least 4%, at least 5%, at least 10%, at least 12%, or at least 15% or more, fatty acids of chain length C8. In other instances, the *Prototheca* strains containing a transgene encoding a fatty acyl ACP thioesterase that has activity towards fatty acyl-ACP substrate of chain lengths C10 has at least at least 1%, at least 5%, at least 10%, at least 15%, at least 20%, at least 24%, or at least 25% or more, fatty acids of chain length C10. In other instances, the *Prototheca* strains containing a transgene encoding a fatty acyl-ACP thioesterase that has activity towards fatty acyl-ACP substrate of chain length C12 has at least 1%, at least 5%, at least 10%, at least 15%, at least 20%, at least 25%, at least 30%, at least 34%, at least 35% or at least 40% or more, fatty acids of the chain length C12. In other cases, the *Prototheca* strains containing a transgene encoding a fatty acyl-ACP thioesterase that has activity towards fatty acyl-ACP substrate of chain length C14 has at least 1%, at least 2%, at least 3%, at least 4%, at least 5%, at least 6%, at least 7%, at least 10%, at least 15%, at least 30%, at least 43%, or at least 45% or more, fatty acids of the chain length C14.

In non-limiting examples, the *Prototheca* strains containing a transgene encoding a fatty acyl-ACP thioesterase that has activity towards fatty acyl-ACP substrate of chain length C8 has between 1%-25%, or between 1%-15%, preferably 1.8-12.29%, fatty acids of chain length C8. In other non-limiting examples, *Prototheca* strains containing a transgene encoding a fatty acyl-ACP thioesterase that has activity towards fatty acyl-ACP substrate of chain length C10 has between 1%-50%, or between 1%-25%, preferably 1.91-23.97% fatty acids of chain length C10. In other non-limiting examples, *Prototheca* strains containing a transgene encoding a fatty acyl-ACP thioesterase that has activity towards fatty acyl-ACP substrate of chain length C12 has between 5%-50%, or between 10%-40, preferably 13.55-34.01%, fatty acids of the chain length C12. In other non-limiting examples, *Prototheca* strains containing a transgene encoding a fatty acyl-ACP thioesterase that has activity towards fatty acyl-ACP substrate of chain length C14 has between 1%-60%, or between 2%-45%, preferably 2.59-43.27%, fatty acids of the chain length C14. In other non-limiting examples, *Prototheca* strains containing a transgene encoding a fatty acyl-ACP thioesterase that has broad specificity towards fatty acyl-ACP substrates of varying carbon chain length has up to 30%, up to 35%, or preferably up to 39.45% fatty acids of the chain length C16. In some cases, the *Prototheca* strains containing a transgene encoding a fatty acyl-ACP thioesterase that has activity towards fatty acyl-ACP substrate of chain lengths between C8 and C14 have between 1%-75%, or between 2%-60%, preferably 2.69-57.98%, medium chain (C8-C14) fatty acids. In some cases, the *Prototheca* strains containing a transgene encoding a fatty acyl-ACP thioesterase that has activity towards fatty acyl-ACP substrates of chain lengths between C12 and C14 have at least 30%, at least 40%, or at least 49% C12-C14 fatty acids. In some instances, keeping the transgenic *Prototheca* strains under constant and high selective pressure to retain exogenous genes is advantageous due to the increase in the desired fatty acid of a specific chain length. High levels of exogenous gene retention can also be achieved by inserting exogenous genes into the nuclear chromosomes of the cells using homologous recombination vectors and methods disclosed herein. Recombinant cells containing exogenous genes integrated into nuclear chromosomes are an object of the invention.

Microalgal oil can also include other constituents produced by the microalgae, or incorporated into the microalgal oil from the culture medium. These other constituents can be present in varying amount depending on the culture conditions used to culture the microalgae, the species of microalgae, the extraction method used to recover microalgal oil from the biomass and other factors that may affect microalgal oil composition. Non-limiting examples of such constituents include carotenoids, present from 0.01-0.5 mcg/g, 0.025-0.3 mcg/g, preferably 0.05 to 0.244 micrograms/gram, of oil; chlorophyll A present from 0.01-0.5 mcg/g, 0.025-0.3 mcg/g, preferably 0.045 to 0.268 micrograms/gram, of oil; total chlorophyll of less than 0.1 mcg/g, less than 0.05 mcg/g, preferably less than 0.025 micrograms/gram, of oil; gamma tocopherol present from 1-300 mcg/g, 35-175 mcg/g, preferably 38.3-164 micrograms/gram, of oil; total tocopherols present from 10-500 mcg/g, 50-300 mcg/g, preferably 60.8 to 261.7 microgram/gram, of oil; less than 1%, less than 0.5%, preferably less than 0.25% brassicasterol, campesterol, stigmasterol, or betasitosterol; total tocotrienols less than 400 mcg/g, preferably less than 300 micrograms/gram, of oil; or total tocotrienols present from 100-500 mcg/g, 225-350 mcg/g, preferably 249.6 to 325.3 micrograms/gram, of oil.

The other constituents can include, without limitation, phospholipids, tocopherols, tocotrienols, carotenoids (e.g., alpha-carotene, beta-carotene, lycopene, etc.), xanthophylls (e.g., lutein, zeaxanthin, alpha-cryptoxanthin and beta-crytoxanthin), and various organic or inorganic compounds. In some cases, the oil extracted from *Prototheca* species comprises between 0.001-0.01 mcg/g, 0.0025-0.05 mcg/g, preferably 0.003 to 0.039 microgram lutein/gram, of oil, less than 0.01 mcg/g, less than 0.005 mcg/g, preferably less than 0.003 micrograms lycopene/gram, of oil; and less than 0.01 mcg/g, less than 0.005 mcg/g, preferably less than 0.003 microgram beta carotene/gram, of oil.

In some embodiments, the present invention provides an oleaginous microbial cell comprising a triglyceride oil, wherein the fatty acid profile of the triglyceride oil is selected from the group consisting of: at least about 1%, at least about 2%, at least about 5%, at least about 7%, at least about 10%, or at least about 15%, C8:0; at least about 1%, at least about 5%, at least about 15%, at least about 20%, at least about 25%, or at least about 30%, C10:0; at least about 1%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, or at least about 80%, C12:0; at least about 2%, at least about 5%, at least about 10%, at least about 15%, at least about 20%, at least about 25%, at least about 30%, at least about 35%, at least about 40%, at least about 45%, or at least about 50%, C14:0; at least about 30%, at least about 35%, at least about 40%, at least about 45%, at least about 50%, at least about 55%, at least about 60%, at least about 65%, at least about 70%, at least about 75%, at least about 80%, at least about 85%, or at least about 90%, C16:0; at least about 5%, at least about 10%, at least about 15%, at least about 20%, at least about 25%, at least about 30%, at least about 35%, at least about 40%, at least about 45%, or at least about 50%, C18:0; at least about 60%, at least about 65%, at least about 70%, at least about 75%, at least about 80%, at least about 85%, or at least about 90%, C18:1; less than about 7%, less than about 5%, less than about 3%, less than about 1%, or about 0%, C18:2; and at least about 35%, at least about 40%, at least about 45%, at least about 50%, at least about 55%, at least about 60%, at least about 65%, at least about 70%, at least about 75%, at least about 80%, at least about 85%, or at least about 90%, saturated fatty acids.

In some embodiments, the oleaginous microbial cell comprises triglyceride oil comprising a fatty acid profile selected from the group consisting of: total combined amounts of C8:0 and C10:0 of at least about 10%, at least about 20%, at least about 30%, at least about 40%, at least about 50%, at least about 60%, at least about 70%, at least about 80%, at least about 90%, or about 100%; total combined amounts of C10:0, C12:0, and C14:0 of at least about 50%, at least about 60%, at least about 70%, at least about 80%, at least about 90%, or about 100%; total combined amounts of C16:0, C18:0 and C18:1 of at least about 60%, at least about 70%, at least about 80%, at least about 90%, or about 100%; total combined amounts of C18:0, C18:1 and C18:2 of at least about 60%, at least about 70%, at least about 80%, at least about 90%, or about 100%; total combined amounts of C14:0, C16:0, C18:0 and C18:1 of at least about 60%, at least about 70 s %, at least about 80%, at least about 90%, or about 100%; and total combined amounts of C18:1 and C18:2 of less than about 30%, less than about 25%, less than about 20%, less than about 15%, less than about 10%, less than about 5%, or about 0%, In some embodiments, the oleaginous microbial cell comprises triglyceride oil having a fatty acid profile comprising a ratio of fatty acids selected from the group consisting of: a C8:0 to C10:0 ratio of at least about 5 to 1, at least 6 to 1, at least 7 to 1, at least 8 to 1, at least 9 to 1, or at least 10 to 1; a C10:0 to C12:0 ratio of at least about 6 to 1, at least 7 to 1, at least 8 to 1, at least 9 to 1, or at least 10 to 1; a C12:0 to C14:0 ratio of at least about 5 to 1, at least 6 to 1, at least 7 to 1, at least 8 to 1, at least 9 to 1, or at least 10 to 1; a C14:0 to C12:0 ratio of at least 7 to 1, at least 8 to 1, at least 9 to 1, or at least 10 to 1; and a C14:0 to C16:0 ratio of at least 1 to 2, at least 1 to 3, at least 1 to 4, at least 1 to 5, at least 1 to 6, at least 1 to 7, at least 1 to 8, at least 1 to 9, or at least 1 to 10.

In some embodiments, the present invention provides an oleaginous microbial triglyceride oil composition, wherein the fatty acid profile of the triglyceride oil is selected from the group consisting of: at least about 1%, at least about 2%, at least about 5%, at least about 7%, at least about 10%, or at least about 15%, C8:0; at least about 1%, at least about 5%, at least about 15%, at least about 20%, at least about 25%, or at least about 30% C10:0; at least about 1%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, or at least about 80%, C12:0; at least about 2%, at least about 5%, at least about 10%, at least about 15%, at least about 20%, at least about 25%, at least about 30%, at least about 35%, at least about 40%, at least about 45%, or at least about 50%, C14:0; at least about 30%, at least about 35%, at least about 40%, at least about 45%, at least about 50%, at least about 55%, at least about 60%, at least about 65%, at least about 70%, at least about 75%, at least about 80%, at least about 85%, or at least about 90%, C16:0; at least about 5%, at least about 10%, at least about 15%, at least about 20%, at least about 25%, at least about 30%, at least about 35%, at least about 40%, at least about 45%, or at least about 50%, C18:0; at least about 60%, at least about 65%, at least about 70%, at least about 75%, at least about 80%, at least about 85%, or at least about 90%, C18:1; less than about 7%, less than about 5%, less than about 3%, less than about 1%, or about 0%, C18:2; and at least about 35%, at least about 40%, at least about 45%, at least about 50%, at least about 55%, at least about 60%, at least about 65%, at least about 70%, at least about 75%, at least about 80%, at least about 85%, or at least about 90%, saturated fatty acids.

In some embodiments, the oleaginous microbial triglyceride oil composition comprises triglyceride oil comprising a fatty acid profile in which: the total combined amount of C10:0, C12:0 and C14:0 is at least about 50%, at least bout 60%, at least about 70%, at least about 80%, at least about 90%, or about 100%; the total combined amount of C16:0, C18:0 and C18:1 is at least about 60%, at least about 70%, at least about 80%, at least about 90%, or about 100%; the total combined amount of C18:0, C18:1 and C18:2 is at least about 60%, at least about 70%, at least about 80%, at least about 90%, or about 100%; the total combined amount of C14:0, C16:0, C18:0 and C18:1 is at least about 60%, at least about 70%, at least about 80%, at least about 90%, or about 100%; the total combined amounts of C8:0 and C10:0 is less than about 50%, less than about 45%, less than about 40%, less than about 35%, less than about 30%, less than about 25%, less than about 20%, less than about 15%, less than about 10%, less than about 5%, or about 0%.

In some embodiments, the oleaginous microbial triglyceride oil composition comprises triglyceride oil having a fatty acid profile comprising a ratio of fatty acids selected from the group consisting of: a C8:0 to C10:0 ratio of at least about 5 to 1, at least about 6 to 1, at least about 7 to 1, at least about 8 to 1, at least about 9 to 1, or at least about 10 to 1; a C10:0 to C12:0 ratio of at least about 6 to 1, at least about 7 to 1, at least about 8 to 1, at least about 9 to 1, or at least about 10 to 1; a C12:0 to C14:0 ratio of at least about 5 to 1, at least about 6 to 1, at least about 7 to 1, at least about 8 to 1, at least about 9 to 1, or at least about 10 to 1; a C14:0 to C12:0 ratio of at least about 7 to 1, at least about 8 to 1, at least about 9 to 1, or at least about 10 to 1; a C14:0 to C16:0 ratio of at least about 1 to 2, at least about 1 to 3, at least about 1 to 4, at least about 1 to 5, at least about 1 to 6, at least about 1 to 7, at least about 1 to 8, at least about 1 to 9, or at least about 1 to 10.

In some embodiments, the present invention provides a method of producing an oleaginous microbial triglyceride oil composition having a fatty acid profile selected from the group consisting of: at least about 1%, at least about 2%, at least about 5%, at least about 7%, at least about 10%, or at least about 15%, C8:0; at least about 1%, at least about 5%, at least about 10%, at least about 15%, at least about 20%, at least about 25%, or at least about 30%, C10:0; at least about 1%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, or at least about 80%, C12:0; at least about 2%, at least about 5%, at least about 10%, at least about 15%, at least about 20%, at least about 25%, at least about 30%, at least about 35%, at least about 40%, at least about 45%, or at least about 50%, C14:0; at least about 30%, at least about 35%, at least about 40%, at least about 45%, at least about 50%, at least about 55%, at least about 60%, at least about 65%, at least about 70%, at least about 75%, at least about 80%, at least about 85%, or at least about 90%, C16:0; at least about 5%, at least about 10%, at least about 15%, at least about 20%, at least about 25%, at least about 30%, at least about 35%, at least about 40%, at least about 45%, or at least about 50% C18:0; at least about 60%, at least about 65%, at least about 70%, at least about 75%, at least about 80%, at least about 85%, or at least about 90%, C18:1; less than about 7%, less than about 5%, less than about 3%, less than about 1%, or about 0%, C18:2; and at least about 35%, at least about 40%, at least about 45%, at least about 50%, at least about 55%, at least about 60%, at least about 65%, at least about 70%, at least about 75%, at least about 80%, at least about 85%, or at least about 90%, saturated fatty acids, wherein the method comprises the steps of: (a) cultivating a population of oleaginous microbial cells in a culture medium until at least 10% of the dry cell weight of the oleaginous microbial cells is triglyceride oil; and (b) isolating the triglyceride oil composition from the oleaginous microbial cells.

In some embodiments, the method of producing oleaginous microbial triglyceride oil compositions yields triglyceride oils comprising a fatty acid profile in which: the total combined amount of C10:0, C12:0 and C14:0 is at least about 50%, at least about 60%, at least about 70%, at least about 80%, at least about 90%, or about 100%; the total combined amount of C16:0, C18:0 and C18:1 is at least about 60%, at least about 70%, at least about 80%, at least about 90%, or about 100%; the total combined amount of C18:0, C18:1 and C18:2 is at least about 60%, at least about 70%, at least about 80%, at least about 90%, or about 100%; the total combined amount of C14:0, C16:0, C18:0 and C18:1 is at least about 60%, at least about 70%, at least about 80%, at least about 90%, or about 100%; the total combined amount of C8:0 and C10:0 is less than about 50%, less than about 45%, less than about 40%, less than about 35%, less than about 30%, less than about 25%, less than about 20%, less than about 15%, less than about 10%, less than about 5%, or about 0%.

In some embodiments, the method of producing oleaginous microbial triglyceride oil compositions yields triglyceride oils having a fatty acid profile comprising a ratio of triglyceride oils selected from the group consisting of: a C8:0 to C10:0 ratio of at least about 5 to 1, at least about 6 to 1, at least about 7 to 1, at least about 8 to 1, at least about 9 to 1, or at least about 10 to 1; a C10:0 to C12:0 ratio of at least about 6 to 1, at least about 7 to 1, at least about 8 to 1, at least about 9 to 1, or at least about 10 to 1; a C12:0 to C14:0 ratio of at least about 5 to 1, at least about 6 to 1, at least about 7 to 1, at least about 8 to 1, at least about 9 to 1, or at least about 10 to 1; a C14:0 to C12:0 ratio of at least about 7 to 1, at least about 8 to 1, at least about 9 to 1, or at least about 10 to 1; and a C14:0 to C16:0 ratio of at least about 1 to 2, at least about 1 to 3, at least about 1 to 4, at least about 1 to 5, at least about 1 to 6, at least about 1 to 7, at least about 1 to 8, at least about 1 to 9, or at least about 1 to 10.

III. Genetic Engineering Methods and Materials

The present invention provides methods and materials for genetically modifying microorganisms, including *Prototheca* cells and recombinant host cells, useful in the methods of the present invention, including but not limited to recombinant *Prototheca moriformis*, *Prototheca zopfii*, *Prototheca krugani*, and *Prototheca stagnora* host cells. The description of these methods and materials is divided into subsections for the convenience of the reader. In subsection 1, transformation methods are described. In subsection 2, genetic engineering methods using homologous recombination are described. In subsection 3, expression vectors and components are described.

In certain embodiments of the present invention it is desirable to genetically modify a microorganism to enhance lipid production, modify the properties or proportions of components generated by the microorganism, or to improve or provide de novo growth characteristics on a variety of feedstock materials. *Chlorella*, particularly *Chlorella protothecoides*, *Chlorella minutissima*, *Chlorella sorokiniana*, *Chlorella ellipsoidea*, *Chlorella* sp., and *Chlorella emersonii* are preferred microorganisms for use in the genetic engineering methods described herein, although other *Chlorella* species as well as other varieties of microorganisms can be used.

Promoters, cDNAs, and 3'UTRs, as well as other elements of the vectors, can be generated through cloning techniques using fragments isolated from native sources (see for example Molecular Cloning: A Laboratory Manual, Sambrook et al. (3d edition, 2001, Cold Spring Harbor Press; and U.S. Pat. No. 4,683,202). Alternatively, elements can be generated synthetically using known methods (see for example Gene. 1995 Oct. 16; 164(1):49-53).

1. Engineering Methods—Transformation

Cells can be transformed by any suitable technique including, e.g., biolistics, electroporation (see Maruyama et al. (2004), Biotechnology Techniques 8:821-826), glass bead transformation and silicon carbide whisker transformation. Another method that can be used involves forming protoplasts and using $CaCl_2$ and polyethylene glycol (PEG) to introduce recombinant DNA into microalgal cells (see Kim et al. (2002), *Mar. Biotechnol.* 4:63-73, which reports the use of this method for the transformation of *Chorella ellipsoidea*). Co-transformation of microalgae can be used to introduce two distinct vector molecules into a cell simultaneously (see for example Protist 2004 December; 155(4):381-93).

Biolistic methods (see, for example, Sanford, Trends In Biotech. (1988) 6:299 302, U.S. Pat. No. 4,945,050; electroporation (Fromm et al., Proc. Nat'l. Acad. Sci. (USA) (1985) 82:5824 5828); use of a laser beam, microinjection or any other method capable of introducing DNA into a microalgae can also be used for transformation of a *Prototheca* cell.

Any convenient technique for introducing a transgene into a microorganism, such as *Chorella*, can be employed in the present invention. Dawson et al. (1997) (supra) described the use of micro-projectile bombardment to introduce the nitrate reductase (NR) gene from *Chlorella vulgaris* into NR-deficient *Chlorella sorokiniana* mutants, resulting in stable transformants. Briefly, 0.4 micron tungsten beads were coated with plasmid; $3 \times 10^7$ *C. sorokiniana* cells were spread in the center third of a non-selective agar plate and bombarded with the PDS-1000/He Biolistic Particle Delivery® system (Bio-Rad).

A preferred method for introducing a transgene into a microorganism, such as *Chlorella*, is the method described by Kim et al. (2002), *Mar. Biotechnol.* 4:63-73. Kim reports the transformation of *Chorella ellipsoidea* protoplasts using $CaCl_2$ and polyethylene glycol (PEG). In particular, protoplasts were prepared by growing *C. ellipsoidea* cells to a density of $1-2 \times 10^8$/Ml. Cells were recovered and washed by centrifugation for 5 minutes at 1600 g and resuspended in 5 Ml of phosphate buffer (Ph 6.0) containing 0.6 M sorbitol, 0.6 M mannitol, 4% (weight/volume) cellulose (Calbiochem), 2% (weight/volume) macerase (Calbiochem), and 50 units pectinase (Sigma). The cell suspension was incubated at 25° C. for 16 hours in the dark with gentle shaking. The resultant protoplasts were recovered by centrifugation at 400 g for 5 minutes. The pellet was gently resuspended in 5 Ml of f/2 medium containing 0.6 M sorbitol and 0.6 M mannitol and centrifuged at 400 g for 5 minutes. This pellet was resuspended in 1 Ml of 0.6 M sorbitol/mannitol solution containing 50 mM $CaCl_2$. Then, 5 mg of transgene DNA was added, along with 25 μg calf thymus DNA (Sigma), to $10^7$-$10^8$ protoplasts in 0.4 Ml. After 15 minutes at room temperature, 200 μL of PNC (40% polyethylene glycol 4000, 0.8 M NaCl, 50 Mm $CaCl_2$) was added and mixed gently for 30 minutes at room temperature. After this, 0.6 Ml of f/2 medium supplemented with 0.6 M sorbitol/mannitol solution, 1% yeast extract and 1% glucose was added, and the transformed cells were incubated at 25° C. for 12 hours in the dark for cell wall regeneration. A similar method was used by Huang et al. (2007) (supra) to introduce a transgene encoding mercuric reductase into *Chlorella* sp. DT.

Electorporation has also been employed to transform microorganisms, such as *Chorella*. As reported by Maruyama et al. (2004), Biotechnology Techniques 8:821-826 (incorporated by reference herein in its entirety), this technique was used to introduce a transgene into protoplasts of *Chlorella saccharophila* c-211-1a prepared from the cells in the stationary phase. Transient expression of the introduced plasmid was observed under a field strength of between 600 and 900 V/cm, and a pulse duration of around 400 ms, where high membrane permeability to 70-kDa FITC-dextran was ascertained.

Examples of expression of transgenes in microorganisms, such as *Chlorella*, can be found in the literature (see for example Current Microbiology Vol. 35 (1997), pp. 356-362; Sheng Wu Gong Cheng Xue Bao. 2000 July; 16(4):443-6; Current Microbiology Vol. 38 (1999), pp. 335-341; Appl Microbiol Biotechnol (2006) 72: 197-205; Marine Biotechnology 4, 63-73, 2002; Current Genetics 39:5, 365-370 (2001); Plant Cell Reports 18:9, 778-780, (1999); Biologia Plantarium 42(2): 209-216, (1999); Plant Pathol. J 21(1): 13-20, (2005)). Also see Examples herein.

Examples of expression of transgenes in oleaginous yeast (e.g., *Yarrowia lipolytica*) can be found in the literature (see, for example, Bordes et al., J Microbiol Methods, June 27 (2007)). Examples of expression of transgenes in fungi (e.g., *Mortierella alpine, Mucor circinelloides*, and *Aspergillus ochraceus*) can also be found in the literature (see, for example, Microbiology, July; 153(Pt. 7):2013-25 (2007); Mol Genet Genomics, June; 271(5):595-602 (2004); Curr Genet, March; 21(3):215-23 (1992); Current Microbiology, 30(2):83-86 (1995); Sakuradani, NISR Research Grant, "Studies of Metabolic Engineering of Useful Lipid-producing Microorganisms" (2004); and PCT/JP2004/012021). Examples of expression of exogenous genes in bacteria such as *E. coli* are well known; see for example Molecular Cloning: A Laboratory Manual, Sambrook et al. (3d edition, 2001, Cold Spring Harbor Press.

Vectors for transformation of microorganisms in accordance with the present invention can be prepared by known techniques familiar to those skilled in the art. The nucleotide sequence of the construct used for transformation of multiple *Chlorella* species corresponds to SEQ ID NO: 8. In one embodiment, an exemplary vector design for expression of a lipase gene in a microorganism such as a microalgae contains a gene encoding a lipase in operable linkage with a promoter active in microalgae. Alternatively, if the vector does not contain a promoter in operable linkage with the gene of interest, the gene can be transformed into the cells such that it becomes operably linked to an endogenous promoter at the point of vector integration. The promoterless method of transformation has been proven to work in microalgae (see for example Plant Journal 14:4, (1998), pp. 441-447). The vector can also contain a second gene that encodes a protein that, e.g., imparts resistance to an antibiotic or herbicide, i.e., a selectable marker. Optionally, one or both gene(s) is/are followed by a 3' untranslated sequence containing a polyadenylation signal. Expression cassettes encoding the two genes can be physically linked in the vector or on separate vectors. Co-transformation of microalgae can also be used, in which distinct vector molecules are simultaneously used to transform cells (see for example Protist 2004 December; 155(4): 381-93). The transformed cells can be optionally selected based upon the ability to grow in the presence of the antibiotic or other selectable marker under conditions in which cells lacking the resistance cassette would not grow.

2. Engineering Methods—Homologous Recombination

Homologous recombination is the ability of complementary DNA sequences to align and exchange regions of homology. Transgenic DNA ("donor") containing sequences homologous to the genomic sequences being targeted ("template") is introduced into the organism and then undergoes recombination into the genome at the site of the corresponding genomic homologous sequences. The mechanistic steps of this process, in most casees, include: (1) pairing of homologous DNA segments; (2) introduction of double-stranded breaks into the donor DNA molecule; (3) invasion of the template DNA molecule by the free donor DNA ends followed by DNA synthesis; and (4) resolution of double-strand break repair events that result in final recombination products.

The ability to carry out homologous recombination in a host organism has many practical implications for what can be carried out at the molecular genetic level and is useful in the generation of an oleaginous microbe that can produced tailored oils. By its very nature homologous recombination is a precise gene targeting event, hence, most transgenic lines generated with the same targeting sequence will be essentially identical in terms of phenotype, necessitating the screening of far fewer transformation events. Homologous recombination also targets gene insertion events into the host chromosome, resulting in excellent genetic stability, even in the absence of genetic selection. Because different chromosomal loci will likely impact gene expression, even from heterologous promoters/UTRs, homologous recombination can be a method of querying loci in an unfamiliar genome environment and to assess the impact of these environments on gene expression.

Particularly useful genetic engineering applications using homologous recombination is to co-opt specific host regulatory elements such as promoters/UTRs to drive heterologous gene expression in a highly specific fashion. For example, ablation or knockout of desaturase genes/gene families with a heterologous gene encoding a selective marker might be expected to increase overall percentage of saturated fatty acids produced in the host cell. Example 11 describes the homologous recombination targeting constructs and a working example of such desaturase gene ablations or knockouts generated in *Prototheca moriformis*.

Because homologous recombination is a precise gene targeting event, it can be used to precisely modify any nucleotide(s) within a gene or region of interest, so long as sufficient flanking regions have been identified. Therefore, homologous recombination can be used as a means to modify regulatory sequences impacting gene expression of RNA and/ or proteins. It can also be used to modify protein coding regions in an effort to modify enzyme activities such as substrate specificity, affinities and Km, and thus affecting the desired change in metabolism of the host cell. Homologous recombination provides a powerful means to manipulate the gost genome resulting in gene targeting, gene conversion, gene deletion, gene duplication, gene inversion and exchanging gene expression regulatory elements such as promoters, enhancers and 3'UTRs.

Homologous recombination can be achieve by using targeting constructs containing pieces of endogenous sequences to "target" the gene or region of interest within the endogenous host cell genome. Such targeting sequences can either be located 5' of the gene or region of interest, 3' of the gene/region of interest or even flank the gene/region of interest. Such targeting constructs can be transformed into the host cell either as a supercoiled plasmid DNA with additional vector backbone, a PCR product with no vector backbone, or as a linearized molecule. In some cases, it may be advantageous to first expose the homologous sequences within the transgenic DNA (donor DNA) with a restriction enzyme. This step can increase the recombination efficiency and decrease the occurance of undesired events. Other methods of increasing recombination efficiency include using PCR to generate transforming transgenic DNA containing linear ends homologous to the genomic sequences being targeted.

For purposes of non-limiting illustration, regions of donor DNA sequences that are useful for homologous recombination include the KE858 region of DNA in *Prototheca moriformis*. KE858 is a 1.3 kb, genomic fragment that encompasses part of the coding region for a protein that shares homology with the transfer RNA (tRNA) family of proteins. Southern blots have shown that the KE858 sequence is present in a single copy in the *Prototheca moriformis* (UTEX 1435) genome. This region and Examples of using this region for homologous recombination targeting has been described in PCT Application No. PCT/US2009/66142. Another region of donor DNA that is useful is portions of the 6S rRNA genomic sequence. The use of this sequence in homologous recombination in *Prototheca morifomis* are described below in the Examples.

3. Vectors and Vector Components

Vectors for transformation of microorganisms in accordance with the present invention can be prepared by known techniques familiar to those skilled in the art in view of the disclosure herein. A vector typically contains one or more genes, in which each gene codes for the expression of a desired product (the gene product) and is operably linked to one or more control sequences that regulate gene expression or target the gene product to a particular location in the recombinant cell. To aid the reader, this subsection is divided into subsections. Subsection A describes control sequences typically contained on vectors as well as novel control sequences provided by the present invention. Subsection B describes genes typically contained in vectors as well as novel codon optimization methods and genes prepared using them provided by the invention.

A. Control Sequences

Control sequences are nucleic acids that regulate the expression of a coding sequence or direct a gene product to a particular location in or outside a cell. Control sequences that regulate expression include, for example, promoters that regulate transcription of a coding sequence and terminators that terminate transcription of a coding sequence. Another control sequence is a 3' untranslated sequence located at the end of a coding sequence that encodes a polyadenylation signal. Control sequences that direct gene products to particular locations include those that encode signal peptides, which direct the protein to which they are attached to a particular location in or outside the cell.

Thus, an exemplary vector design for expression of an exogenous gene in a microalgae contains a coding sequence for a desired gene product (for example, a selectable marker, a lipid pathway modification enzyme, or a sucrose utilization enzyme) in operable linkage with a promoter active in microalgae. Alternatively, if the vector does not contain a promoter in operable linkage with the coding sequence of interest, the coding sequence can be transformed into the cells such that it becomes operably linked to an endogenous promoter at the point of vector integration. The promoterless method of transformation has been proven to work in microalgae (see for example Plant Journal 14:4, (1998), pp. 441-447).

Many promoters are active in microalgae, including promoters that are endogenous to the algae being transformed, as well as promoters that are not endogenous to the algae being transformed (i.e., promoters from other algae, promoters from higher plants, and promoters from plant viruses or algae viruses). Illustrative exogenous and/or endogenous promoters that are active in microalgae (as well as antibiotic resistance genes functional in microalgae) are described in PCT Pub. No. 2008/151149 and references cited therein).

The promoter used to express an exogenous gene can be the promoter naturally linked to that gene or can be a heterologous gene. Some promoters are active in more than one species of microalgae. Other promoters are species-specific. Illustrative promoters include promoters such as β-tubulin from *Chlamydomonas reinhardtii*, used in the Examples below, and viral promoters, such as cauliflower mosaic virus (CMV) and *chlorella* virus, which have been shown to be active in multiple species of microalgae (see for example Plant Cell Rep. 2005 March; 23(10-11):727-35; J Microbiol. 2005 August; 43(4):361-5; Mar Biotechnol (NY). 2002 January; 4(1):63-73). Another promoter that is suitable for use for expression of exogenous genes in *Prototheca* is the *Chlorella sorokiniana* glutamate dehydrogenase promoter/5'UTR. Optionally, at least 10, 20, 30, 40, 50, or 60 nucleotides or more of these sequences containing a promoter are used. Illustrative promoters useful for expression of exogenous genes in *Prototheca* are listed in the sequence listing of this application, such as the promoter of the *Chlorella* HUP1 gene (SEQ ID NO:1) and the *Chlorella ellipsoidea* nitrate reductase promoter (SEQ ID NO:2). *Chlorella* virus promoters can also be used to express genes in *Prototheca*, such as SEQ ID NOs: 1-7 of U.S. Pat. No. 6,395,965. Additional promoters active in *Prototheca* can be found, for example, in Biochem Biophys Res Commun 1994 Oct. 14; 204(1):187-94; Plant Mol. Biol. 1994 October; 26(1):85-93; Virology. 2004 Aug. 15; 326(1):150-9; and Virology. 2004 Jan. 5; 318(1):214-23. Other useful promoters are described in detail in the Examples below.

A promoter can generally be characterized as either constitutive or inducible. Constitutive promoters are generally active or function to drive expression at all times (or at certain times in the cell life cycle) at the same level. Inducible promoters, conversely, are active (or rendered inactive) or are significantly up- or down-regulated only in response to a stimulus. Both types of promoters find application in the methods of the invention. Inducible promoters useful in the invention include those that mediate transcription of an operably linked gene in response to a stimulus, such as an exogenously provided small molecule (e.g. glucose, as in SEQ ID NO:1), temperature (heat or cold), lack of nitrogen in culture media, etc. Suitable promoters can activate transcription of an essentially silent gene or upregulate, preferably substantially, transcription of an operably linked gene that is transcribed at a low level. Examples below describe additional inducible promoters that are useful in *Prototheca* cells.

Inclusion of termination region control sequence is optional, and if employed, then the choice is be primarily one of convenience, as the termination region is relatively interchangeable. The termination region may be native to the transcriptional initiation region (the promoter), may be native to the DNA sequence of interest, or may be obtainable from another source. See, for example, Chen and Orozco, Nucleic Acids Res. (1988) 16:8411.

The present invention also provides control sequences and recombinant genes and vectors containing them that provide for the compartmentalized expression of a gene of interest. Organelles for targeting are chloroplasts, plastids, mitochondria, and endoplasmic reticulum. In addition, the present invention provides control sequences and recombinant genes and vectors containing them that provide for the secretion of a protein outside the cell.

Proteins expressed in the nuclear genome of *Prototheca* can be targeted to the plastid using plastid targeting signals. Plastid targeting sequences endogenous to *Chlorella* are known, such as genes in the *Chlorella* nuclear genome that encode proteins that are targeted to the plastid; see for example GenBank Accession numbers AY646197 and AF499684, and in one embodiment, such control sequences are used in the vectors of the present invention to target expression of a protein to a *Prototheca* plastid.

The Examples below describe the use of algal plastid targeting sequences to target heterologous proteins to the correct compartment in the host cell. cDNA libraries were made using *Prototheca moriformis* and *Chlorella protothecodies* cells and are described in PCT Application No. PCT/US2009/066142.

In another embodiment of the present invention, the expression of a polypeptide in *Prototheca* is targeted to the endoplasmic reticulum. The inclusion of an appropriate retention or sorting signal in an expression vector ensure that proteins are retained in the endoplasmic reticulum (ER) and do not go downstream into Golgi. For example, the IMPACTVECTOR1.3 vector, from Wageningen UR—Plant Research International, includes the well known KDEL retention or sorting signal. With this vector, ER retention has a practical advantage in that it has been reported to improve expression levels 5-fold or more. The main reason for this appears to be that the ER contains lower concentrations and/or different proteases responsible for post-translational degradation of expressed proteins than are present in the cytoplasm. ER retention signals functional in green microalgae are known. For example, see Proc Natl Acad Sci USA. 2005 Apr. 26; 102(17):6225-30.

In another embodiment of the present invention, a polypeptide is targeted for secretion outside the cell into the culture media. See Hawkins et al., Current Microbiology Vol. 38 (1999), pp. 335-341 for examples of secretion signals active in *Chlorella* that can be used, in accordance with the methods of the invention, in *Prototheca*.

Many promoters are active in microalgae, including promoters that are endogenous to the algae being transformed, as well as promoters that are not endogenous to the algae being transformed (i.e., promoters from other algae, promoters from higher plants, and promoters from plant viruses or algae viruses). Exogenous and/or endogenous promoters that are active in microalgae, and antibiotic resistance genes functional in microalgae are described by e.g., Curr Microbiol. 1997 December; 35(6):356-62 (*Chlorella vulgaris*); Mar Biotechnol (NY). 2002 January; 4(1):63-73 (*Chlorella ellipsoidea*); Mol Gen Genet. 1996 Oct. 16; 252(5):572-9 (*Phaeodactylum tricornutum*); Plant Mol. Biol. 1996 April; 31(1):1-12 (*Volvox carteri*); Proc Natl Acad Sci USA. 1994 Nov. 22; 91(24):11562-6 (*Volvox carteri*); Falciatore A, Casotti R, Leblanc C, Abrescia C, Bowler C, PMID: 10383998, 1999 May; 1(3):239-251 (Laboratory of Molecular Plant Biology, Stazione Zoologica, VIIIa Comunale, 1-80121 Naples, Italy) (*Phaeodactylum tricornutum* and *Thalassiosira weissflogii*); Plant Physiol. 2002 May; 129(1):7-12. (*Porphyridium* sp.); Proc Natl Acad Sci USA. 2003 Jan. 21; 100(2):438-42. (*Chlamydomonas reinhardtii*); Proc Natl Acad Sci USA. 1990 February; 87(3):1228-32. (*Chlamydomonas reinhardtii*); Nucleic Acids Res. 1992 Jun. 25; 20(12):2959-65; Mar Biotechnol (NY). 2002 January; 4(1):63-73 (*Chlorella*); Biochem Mol Biol Int. 1995 August; 36(5):1025-35 (*Chlamydomonas reinhardtii*); J Microbiol. 2005 August; 43(4):361-5 (*Dunaliella*); Yi Chuan Xue Bao. 2005 April; 32(4):424-33 (*Dunaliella*); Mar Biotechnol (NY). 1999 May; 1(3):239-251. (*Thalassiosira* and *Phaedactylum*); Koksharova, Appl Microbiol Biotechnol 2002 February; 58(2): 123-37 (various species); Mol Genet Genomics. 2004 February; 271(1):50-9 (*Thermosynechococcus elongates*); J. Bacteriol. (2000), 182, 211-215; FEMS Microbiol Lett. 2003 Apr. 25; 221(2):155-9; Plant Physiol. 1994 June; 105(2):635-41; Plant Mol. Biol. 1995 December; 29(5):897-907 (*Synechococcus* PCC 7942); Mar Pollut Bull. 2002; 45(1-12): 163-7 (*Anabaena* PCC 7120); Proc Natl Acad Sci USA. 1984 March; 81(5):1561-5 (*Anabaena* (various strains)); Proc Natl Acad Sci USA. 2001 Mar. 27; 98(7):4243-8 (*Synechocystis*); Wirth, Mol Gen Genet. 1989 March; 216(1):175-7 (various species); Mol Microbiol, 2002 June; 44(6):1517-31 and Plasmid, 1993 September; 30(2):90-105 (*Fremyella diplosiphon*); Hall et al. (1993) Gene 124: 75-81 (*Chlamydomonas reinhardtii*); Gruber et al. (1991). Current Micro. 22: 15-20; Jarvis et al. (1991) Current Genet. 19: 317-322 (*Chlorella*); for additional promoters see also table 1 from U.S. Pat. No. 6,027,900).

The promoter used to express an exogenous gene can be the promoter naturally linked to that gene or can be a heterologous gene. Some promoters are active in more than one species of microalgae. Other promoters are species-specific. Preferred promoters include promoters such as RBCS2 from *Chlamydomonas reinhardtii* and viral promoters, such as cauliflower mosaic virus (CMV) and *chlorella* virus, which have been shown to be active in multiple species of microalgae (see for example Plant Cell Rep. 2005 March; 23(10-11):727-35; J Microbiol. 2005 August; 43(4):361-5; Mar Biotechnol (NY). 2002 January; 4(1):63-73). In other embodiments, the *Botryococcus* malate dehydrogenase promoter, such a nucleic acid comprising any part of SEQ ID NO: 150, or the *Chlamydomonas reinhardtii* RBCS2 promoter (SEQ ID NO: 151) can be used. Optionally, at least 10, 20, 30, 40, 50, or 60 nucleotides or more of these sequences containing a promoter are used. Preferred promoters endogenous to species of the genus *Chlorella* are SEQ ID NO:1 and SEQ ID NO:2.

Preferred promoters useful for expression of exogenous genes in *Chlorella* are listed in the sequence listing of this application, such as the promoter of the *Chlorella* HUP1 gene (SEQ ID NO:1) and the *Chlorella ellipsoidea* nitrate reductase promoter (SEQ ID NO:2). *Chlorella* virus promoters can also be used to express genes in *Chlorella*, such as SEQ ID NOs: 1-7 of U.S. Pat. No. 6,395,965. Additional promoters active in *Chlorella* can be found, for example, in Biochem Biophys Res Commun. 1994 Oct. 14; 204(1):187-94; Plant Mol. Biol. 1994 October; 26(1):85-93; Virology. 2004 Aug. 15; 326(1):150-9; and Virology. 2004 Jan. 5; 318(1):214-23.

B. Genes and Codon Optimization

Typically, a gene includes a promoter, coding sequence, and termination control sequences. When assembled by recombinant DNA technology, a gene may be termed an expression cassette and may be flanked by restriction sites for convenient insertion into a vector that is used to introduce the recombinant gene into a host cell. The expression cassette can be flanked by DNA sequences from the genome or other nucleic acid target to facilitate stable integration of the expression cassette into the genome by homologous recombination. Alternatively, the vector and its expression cassette may remain unintegrated, in which case, the vector typically includes an origin of replication, which is capable of providing for replication of the heterologous vector DNA.

A common gene present on a vector is a gene that codes for a protein, the expression of which allows the recombinant cell containing the protein to be differentiated from cells that do not express the protein. Such a gene, and its corresponding gene product, is called a selectable marker. Any of a wide variety of selectable markers can be employed in a transgene construct useful for transforming *Prototheca*. Examples of suitable selectable markers include the G418 resistance gene, the nitrate reductase gene (see Dawson et al. (1997), Current Microbiology 35:356-362), the hygromycin phosphotransferase gene (HPT; see Kim et al. (2002), Mar. Biotechnol. 4:63-73), the neomycin phosphotransferase gene, the ble gene, which confers resistance to phleomycin (Huang et al. (2007), Appl. Microbiol. Biotechnol. 72:197-205), and the aminoglycoside-3'-O-phosphotransferase (SEQ ID NO: 194), which confers resistance to kanamycin. Methods of determining sensitivity of microalgae to antibiotics are well known. For example, Mol Gen Genet. 1996 Oct. 16; 252(5): 572-9.

Other selectable markers that are not antibiotic-based can alsobe employed in a transgene construct useful for transforming microalgae in general, including *Prototheca* species. Genes that confers the ability to utilize certain carbon sources that were previously unable to be utilized by the microalgae can also be used as a selectable marker. By way of illustration, *Prototheca moriformis* strains typically grow poorly, if at all, on sucrose. Using a construct containing a sucrose invertase gene can confer the ability of positive transformants to grow on sucrose as a carbon substrate. Additional details on using sucrose utilization as a selectable marker along with other selectable markers are discussed in Section IV below.

For purposes of the present invention, the expression vector used to prepare a recombinant host cell of the invention will include at least two, and often three, genes, if one of the genes is a selectable marker. For example, a genetically engineered *Prototheca* of the invention can be made by transformation with vectors of the invention that comprise, in addition to a selectable marker, one or more exogenous genes, such as, for example, sucrose invertase gene or acyl ACP-thioesterase gene. One or both genes can be expressed using an inducible promoter, which allows the relative timing of expression of these genes to be controlled to enhance the lipid yield and conversion to fatty acid esters. Expression of the two or more exogenous genes may be under control of the same inducible promoter or under control of different inducible (or constitutive) promoters. In the latter situation, expression of a first exogenous gene can be induced for a first period of time (during which expression of a second exogenous gene may or may not be induced) and expression of a second exogenous gene can be induced for a second period of time (during which expression of a first exogenous gene may or may not be induced).

In other embodiments, the two or more exogenous genes (in addition to any selectable marker) are: a fatty acyl-ACP thioesterase and a fatty acyl-CoA/aldehyde reductase, the combined action of which yields an alcohol product. Further provided are other combinations of exogenous genes, including without limitation, a fatty acyl-ACP thioesterase and a fatty acyl-CoA reductase to generate aldehydes. In one embodiment, the vector provides for the combination of a fatty acyl-ACP thioesterase, a fatty acyl-CoA reductase, and a fatty aldehyde decarbonylase to generate alkanes. In each of these embodiments, one or more of the exogenous genes can be expressed using an inducible promoter.

Other illustrative vectors of the invention that express two or more exogenous genes include those encoding both a sucrose transporter and a sucrose invertase enzyme and those encoding both a selectable marker and a secreted sucrose invertase. The recombinant *Prototheca* transformed with either type of vector produce lipids at lower manufacturing cost due to the engineered ability to use sugar cane (and sugar cane-derived sugars) as a carbon source. Insertion of the two exogenous genes described above can be combined with the disruption of polysaccharide biosynthesis through directed and/or random mutagenesis, which steers ever greater carbon flux into lipid production. Individually and in combination, trophic conversion, engineering to alter lipid production and treatment with exogenous enzymes alter the lipid composition produced by a microorganism. The alteration can be a change in the amount of lipids produced, the amount of one or more hydrocarbon species produced relative to other lipids, and/or the types of lipid species produced in the microorganism. For example, microalgae can be engineered to produce a higher amount and/or percentage of TAGs.

For optimal expression of a recombinant protein, it is beneficial to employ coding sequences that produce mRNA with codons preferentially used by the host cell to be transformed. Thus, proper expression of transgenes can require that the codon usage of the transgene matches the specific codon bias of the organism in which the transgene is being expressed. The precise mechanisms underlying this effect are many, but include the proper balancing of available aminoacylated tRNA pools with proteins being synthesized in the cell, coupled with more efficient translation of the transgenic messenger RNA (mRNA) when this need is met. When codon usage in the transgene is not optimized, available tRNA pools are not sufficient to allow for efficient translation of the heterologous mRNA resulting in ribosomal stalling and termination and possible instability of the transgenic mRNA.

The present invention provides codon-optimized nucleic acids useful for the successful expression of recombinant proteins in *Prototheca*. Codon usage in *Prototheca* species was analyzed by studying cDNA sequences isolated from *Prototheca moriformis*. This analysis represents the interrogation over 24,000 codons and resulted in Table 2 below.

TABLE 2

Preferred codon usage in *Prototheca* strains.

| Ala | GCG | 345 (0.36) | Asn | AAT | 8 (0.04) |
|---|---|---|---|---|---|
| | GCA | 66 (0.07) | | AAC | 201 (0.96) |
| | GCT | 101 (0.11) | Pro | CCG | 161 (0.29) |
| | GCC | 442 (0.46) | | CCA | 49 (0.09) |
| Cys | TGT | 12 (0.10) | | CCT | 71 (0.13) |
| | TGC | 105 (0.90) | | CCC | 267 (0.49) |
| Asp | GAT | 43 (0.12) | Gln | CAG | 226 (0.82) |
| | GAC | 316 (0.88) | | CAA | 48 (0.18) |
| Glu | GAG | 377 (0.96) | Arg | AGG | 33 (0.06) |
| | GAA | 14 (0.04) | | AGA | 14 (0.02) |
| Phe | TTT | 89 (0.29) | | CGG | 102 (0.18) |
| | TTC | 216 (0.71) | | CGA | 49 (0.08) |
| Gly | GGG | 92 (0.12) | | CGT | 51 (0.09) |
| | GGA | 56 (0.07) | | CGC | 331 (0.57) |
| | GGT | 76 (0.10) | Ser | AGT | 16 (0.03) |
| | GGC | 559 (0.71) | | AGC | 123 (0.22) |

TABLE 2-continued

Preferred codon usage in Prototheca strains.

| | | | | | |
|---|---|---|---|---|---|
| His | CAT | 42 (0.21) | | TCG | 152 (0.28) |
| | CAC | 154 (0.79) | | TCA | 31 (0.06) |
| Ile | ATA | 4 (0.01) | | TCT | 55 (0.10) |
| | ATT | 30 (0.08) | | TCC | 173 (0.31) |
| | ATC | 338 (0.91) | Thr | ACG | 184 (0.38) |
| Lys | AAG | 284 (0.98) | | ACA | 24 (0.05) |
| | AAA | 7 (0.02) | | ACT | 21 (0.05) |
| Leu | TTG | 26 (0.04) | | ACC | 249 (0.52) |
| | TTA | 3 (0.00) | Val | GTG | 308 (0.50) |
| | CTG | 447 (0.61) | | GTA | 9 (0.01) |
| | CTA | 20 (0.03) | | GTT | 35 (0.06) |
| | CTT | 45 (0.06) | | GTC | 262 (0.43) |
| | CTC | 190 (0.26) | Trp | TGG | 107 (1.00) |
| Met | ATG | 191 (1.00) | Tyr | TAT | 10 (0.05) |
| | | | | TAC | 180 (0.95) |
| | | | Stop | TGA/TAG/TAA | |

In other embodiments, the gene in the recombinant vector has been codon-optimized with reference to a microalgal strain other than a *Prototheca* strain. For example, methods of recoding genes for expression in microalgae are described in U.S. Pat. No. 7,135,290. Additional information for codon optimization is available, e.g., at the codon usage database of GenBank.

Other non-limiting examples of codon usage in *Chlorella pyrenoidosa*, *Dunaliella Salina*, and *Chlorella protothecoides* are shown in Tables 2A, 2B, and 2C, respectively.

TABLE 2A

Codon usage in *Chlorella pyrenoidosa*.

| | | | | | |
|---|---|---|---|---|---|
| Phe | UUU | 39 (0.82) | Ser | UCU | 50 (1.04) |
| | UUC | 56 (1.18) | | UCC | 60 (1.25) |
| Leu | UUA | 10 (0.20) | | UCA | 6 (0.96) |
| | UUG | 46 (0.91) | | UCG | 43 (0.89) |
| Tyr | UAU | 15 (0.59) | Cys | UGU | 46 (0.77) |
| | UAC | 36 (1.41) | | UGC | 73 (1.23) |
| ter | UAA | 9 (0.00) | ter | UGA | 43 (0.00) |
| ter | UAG | 15 (0.00) | Trp | UGG | 69 (1.00) |
| Leu | CUU | 49 (0.97) | Pro | CCU | 80 (0.98) |
| | CUC | 73 (1.45) | | CCC | 88 (1.08) |
| | CUA | 22 (0.44) | | CCA | 93 (1.14) |
| | CUG | 103 (2.04) | | CCG | 65 (0.80) |
| His | CAU | 50 (0.88) | Arg | CGU | 39 (0.76) |
| | CAC | 3 (1.12) | | CGC | 63 (1.23) |
| Gln | CAA | 59 (0.84) | | CGA | 46 (0.90) |
| | CAG | 2 (1.16) | | CGG | 47 (0.92) |
| Ile | AUU | 24 (0.69) | Thr | ACU | 32 (0.67) |
| | AUC | 61 (1.76) | | ACC | 76 (1.60) |
| | AUA | 19 (0.55) | | ACA | 41 (0.86) |
| Met | AUG | 42 (1.00) | | ACG | 41 (0.86) |
| Asn | AAU | 26 (0.75) | Ser | AGU | 23 (0.48) |
| | AAC | 3 (1.25) | | AGC | 67 (1.39) |
| Lys | AAA | 32 (0.54) | Arg | AGA | 51 (1.00) |
| | AAG | 86 (1.46) | | AGG | 61 (1.19) |
| Val | GUU | 36 (0.75) | Ala | GCU | 57 (0.79) |
| | GUC | 54 (1.13) | | GCC | 97 (1.34) |
| | GUA | 30 (0.63) | | GCA | 89 (1.23) |
| | GUG | 71 (1.49) | | GCG | 47 (0.65) |
| Asp | GAU | 60 (0.95) | Gly | GGU | 35 (0.60) |
| | GAC | 66 (1.05) | | GGC | 78 (1.33) |
| Glu | GAA | 41 (0.68) | | GGA | 54 (0.92) |
| | GAG | 80 (1.32) | | GGG | 67 (1.15) |

TABLE 2B

Preferred codon usage in *Dunaliella salina*.

| | | | |
|---|---|---|---|
| TTC (Phe) | TAC (Tyr) | TGC (Cys) | TAA (Stop) |
| TGG (Trp) | CCC (Pro) | CAC (His) | CGC (Arg) |
| CTG (Leu) | CAG (Gln) | ATC (Ile) | ACC (Thr) |

TABLE 2B-continued

Preferred codon usage in *Dunaliella salina*.

| | | | |
|---|---|---|---|
| AAC (Asn) | AGC (Ser) | ATG (Met) | AAG (Lys) |
| GCC (Ala) | GAC (Asp) | GGC (Gly) | GTG (Val) |
| GAG (Glu) | | | |

TABLE 2C

Preferred codon usage in *Chlorella protothecoides*.

| | | | |
|---|---|---|---|
| TTC (Phe) | TAC (Tyr) | TGC (Cys) | TGA (Stop) |
| TGG (Trp) | CCC (Pro) | CAC (His) | CGC (Arg) |
| CTG (Leu) | CAG (Gln) | ATC (Ile) | ACC (Thr) |
| GAC (Asp) | TCC (Ser) | ATG (Met) | AAG (Lys) |
| GCC (Ala) | AAC (Asn) | GGC (Gly) | GTG (Val) |
| GAG (Glu) | | | |

C. Inducible Expression

The present invention also provides for the use of an inducible promoter to express a gene of interest. In particular, the use of an inducible promoter to express a lipase gene permits production of the lipase after growth of the microorganism when conditions have been adjusted, if necessary, to enhance transesterification, for example, after disruption of the cells, reduction of the water content of the reaction mixture, and/or addition sufficient alcohol to drive conversion of TAGs to fatty acid esters.

Inducible promoters useful in the invention include those that mediate transcription of an operably linked gene in response to a stimulus, such as an exogenously provided small molecule (e.g, glucose, as in SEQ ID NO:1), temperature (heat or cold), light, etc. Suitable promoters can activate transcription of an essentially silent gene or upregulate, preferably substantially, transcription of an operably linked gene that is transcribed at a low level. In the latter case, the level of transcription of the lipase preferably does not significantly interfere with the growth of the microorganism in which it is expressed.

Expression of transgenes in *Chlorella* can be performed inducibly through promoters such as the promoter that drives the *Chlorella* hexose transporter gene (SEQ ID NO:1). This promoter is strongly activated by the presence of glucose in the culture media.

D. Expression of Two or More Exogenous Genes

Further, a genetically engineered microorganism, such as a microalgae, may comprise and express two or more exogenous genes, such as, for example, a lipase and a lytic gene, e.g., one encoding a polysaccharide-degrading enzyme. One or both genes can be expressed using an inducible promoter, which allows the relative timing of expression of these genes to be controlled to enhance the lipid yield and conversion to fatty acid esters. Expression of the two or more exogenous genes may be under control of the same inducible promoter or under control of a different inducible promoters. In the latter situation, expression of a first exogenous gene can be induced for a first period of time (during which expression of a second exogenous gene may or may not be induced) and expression of a second exogenous gene can be induced for a second period of time (during which expression of a first exogenous gene may or may not be induced). Provided herein are vectors and methods for engineering lipid-producing microbes to metabolize sucrose, which is an advantageous trait because it allows the engineered cells to convert sugar cane feedstocks into lipids.

Also provided herein are genetically engineered strains of microbes (e.g., microalgae, oleaginous yeast, bacteria, or fungi) that express two or more exogenous genes, such as, for example, a fatty acyl-ACP thioesterase and a fatty acyl-CoA/aldehyde reductase, the combined action of which yields an alcohol product. Further provided are other combinations of exogenous genes, including without limitation, a fatty acyl-ACP thioesterase and a fatty acyl-CoA reductase to generate aldehydes. In addition, this application provides for the combination of a fatty acyl-ACP thioesterase, a fatty acyl-CoA reductase, and a fatty aldehyde decarbonylase to generate alkanes. One or more of the exogenous genes can be expressed using an inducible promoter.

Examples of further modifications suitable for use in the present invention are include genetically engineering strains of microalgae to express two or more exogenous genes, one encoding a transporter of a fixed carbon source (such as sucrose) and a second encoding a sucrose invertase enzyme. The resulting fermentable organisms produce hydrocarbons at lower manufacturing cost than what has been obtainable by previously known methods of biological hydrocarbon production. Insertion of the two exogenous genes described above can be combined with the disruption of polysaccharide biosynthesis through directed and/or random mutagenesis, which steers ever greater carbon flux into hydrocarbon production. Individually and in combination, trophic conversion, engineering to alter hydrocarbon production and treatment with exogenous enzymes alter the hydrocarbon composition produced by a microorganism. The alteration can be a change in the amount of hydrocarbons produced, the amount of one or more hydrocarbon species produced relative to other hydrocarbons, and/or the types of hydrocarbon species produced in the microorganism. For example, microalgae can be engineered to produce a higher amount and/or percentage of TAGs.

E. Compartmentalized Expression

The present invention also provides for compartmentalized expression of a gene of interest. In particular, it can be advantageous, in particular embodiments, to target expression of the lipase to one or more cellular compartments, where it is sequestered from the majority of cellular lipids until initiation of the transesterification reaction. Preferred organelles for targeting are chloroplasts, mitochondria, and endoplasmic reticulum.

(1) Expression in Chloroplasts

In one embodiment of the present invention, the expression of a polypeptide in a microorganism is targeted to chloroplasts. Methods for targeting expression of a heterologous gene to the chloroplast are known and can be employed in the present invention. Methods for targeting foreign gene products into chloroplasts are described in Shrier et al., EMBO J. (1985) 4:25 32. See also Tomai et al. Gen. Biol. Chem. (1988) 263:15104 15109 and U.S. Pat. No. 4,940,835 for the use of transit peptides for translocating nuclear gene products into the chloroplast. Methods for directing the transport of proteins to the chloroplast are also reviewed in Kenauf TIBTECH (1987) 5:40 47. Chloroplast targeting sequences endogenous to *Chlorella* are known, such as genes in the *Chlorella* nuclear genome that encode proteins that are targeted to the chloroplast; see for example GenBank Accession numbers AY646197 and AF499684.

Wageningen UR—Plant Research International sells an IMPACTVECTOR1.4 vector, which uses the secretion signal of the *Chrysanthemum morifolium* small subunit protein to deliver a heterologous protein into the chloroplast stroma (cytoplasmic) environment, shuttling across a double membrane system. The protein is fused to the first 11 amino acids of the mature rubisco protein in order to allow proper processing of the signal peptide (Wong et al., Plant Molecular Biology 20: 81-93 (1992)). The signal peptide contains a natural intron from the RbcS gene.

In another approach, the chloroplast genome is genetically engineered to express the heterologous protein. Stable transformation of chloroplasts of *Chlamydomonas reinhardtii* (a green alga) using bombardment of recipient cells with high-velocity tungsten microprojectiles coated with foreign DNA has been described. See, for example, Boynton et al., Science (1988) 240: 1534 1538; Blowers et al. Plant Cell (1989) 1:123 132 and Debuchy et al., EMBO J. (1989) δ: 2803 2809. The transformation technique, using tungsten microprojectiles, is described by Klein et al., Nature (London) (1987) 7:70 73. Other methods of chloroplast transformation for both plants and microalgae are known. See for example U.S. Pat. Nos. 5,693,507; 6,680,426; and Plant Physiol. 2002 May; 129(1): 7-12; and Plant Biotechnol J. 2007 May; 5(3):402-12.

As described in U.S. Pat. No. 6,320,101 (issued Nov. 20, 2001 to Kaplan et al.; which is incorporated herein by reference), cells can be chemically treated so as to reduce the number of chloroplasts per cell to about one. Then, the heterologous nucleic acid can be introduced into the cells via particle bombardment with the aim of introducing at least one heterologous nucleic acid molecule into the chloroplasts. The heterologous nucleic acid is selected such that it is integratable into the chloroplast's genome via homologous recombination which is readily effected by enzymes inherent to the chloroplast. To this end, the heterologous nucleic acid includes, in addition to a gene of interest, at least one nucleic acid sequence that is derived from the chloroplast's genome. In addition, the heterologous nucleic acid typically includes a selectable marker. Further details relating to this technique are found in U.S. Pat. Nos. 4,945,050 and 5,693,507 which are incorporated herein by reference. A polypeptide can thus be produced by the protein expression system of the chloroplast.

U.S. Pat. No. 7,135,620 (issued Nov. 14, 2006 to Daniell et al.; incorporated herein by reference) describes chloroplast expression vectors and related methods. Expression cassettes are DNA constructs including a coding sequence and appropriate control sequences to provide for proper expression of the coding sequence in the chloroplast. Typical expression cassettes include the following components: the 5' untranslated region from a microorganism gene or chloroplast gene such as psbA which will provide for transcription and translation of a DNA sequence encoding a polypeptide of interest in the chloroplast; a DNA sequence encoding a polypeptide of interest; and a translational and transcriptional termination region, such as a 3' inverted repeat region of a chloroplast gene that can stabilize RNA of introduced genes, thereby enhancing foreign gene expression. The cassette can optionally include an antibiotic resistance gene.

Typically, the expression cassette is flanked by convenient restriction sites for insertion into an appropriate genome. The expression cassette can be flanked by DNA sequences from chloroplast DNA to facilitate stable integration of the expression cassette into the chloroplast genome, particularly by homologous recombination. Alternatively, the expression cassette may remain unintegrated, in which case, the expression cassette typically includes a chloroplast origin of replication, which is capable of providing for replication of the heterologous DNA in the chloroplast.

The expression cassette generally includes a promoter region from a gene capable of expression in the chloroplast. The promoter region may include promoters obtainable from chloroplast genes, such as the psbA gene from spinach or pea, or the rbcL and atpB promoter region from maize and Rrna promoters. Examples of promoters are described in Hanley-Bowdoin and Chua, TIBS (1987) 12:67 70; Mullet et al., Plant Molec Biol. (1985) 4: 39 54; Hanley-Bowdoin (1986) PhD. Dissertation, the Rockefeller University; Krebbers et al., Nucleic Acids Res. (1982) 10: 4985 5002; Zurawaki et al., Nucleic Acids Res. (1981) 9:3251 3270; and Zurawski et al., Proc. Nat'l Acad. Sci. U.S.A. (1982) 79: 7699 7703. Other promoters can be identified and the relative strength of promoters so identified evaluated, by placing a promoter of interest 5' to a promoterless marker gene and observing its effectiveness relative to transcription obtained from, for example, the promoter from the psbA gene, a relatively strong chloroplast promoter. The efficiency of heterologus gene expression additionally can be enhanced by any of a variety of techniques. These include the use of multiple promoters inserted in tandem 5' to the heterologous gente, for example a double psbA promoter, the addition of enhancer sequences and the like.

Numerous promoters active in the *Chlorella* chloroplast can be used for expression of exogenous genes in the *Chlorella* chloroplast, such as those found in GenBank accession number NC_001865 (*Chlorella vulgaris* chloroplast, complete genome), Where it is desired to provide for inducible expression of the heterologous gene, an inducible promoter and/or a 5' untranslated region containing sequences which provide for regulation at the level of transcription and/or translation (at the 3' end) may be included in the expression cassette. For example, the 5' untranslated region can be from a gene wherein expression is regulatable by light. Similarly, 3' inverted repeat regions could be used to stabilize RNA of heterologous genes. Inducible genes may be identified by enhanced expression in response to a particular stimulus of interest and low or absent expression in the absence of the stimulus. For example, a light-inducible gene can be identified where enhanced expression occurs during irradiation with light, while substantially reduced expression or no expression occurs in low or no light. Light regulated promoters from green microalgae are known (see for example Mol Genet Genomics. 2005 December; 274(6):625-36).

The termination region which is employed will be primarily one of convenience, since the termination region appears to be relatively interchangeable among chloroplasts and bacteria. The termination region may be native to the transcriptional initiation region, may be native to the DNA sequence of interest, or may be obtainable from another source. See, for example, Chen and Orozco, Nucleic Acids Res. (1988) 16:8411.

The expression cassettes may be transformed into a plant cell of interest by any of a number of methods. These methods include, for example, biolistic methods (See, for example, Sanford, Trends In Biotech. (1988) 6:299 302, U.S. Pat. No. 4,945,050; electroporation (Fromm et al., Proc. Nat'l. Acad. Sci. (USA) (1985) 82:5824 5828); use of a laser beam, microinjection or any other method capable of introducing DNA into a chloroplast.

Additional descriptions of chloroplast expression vectors suitable for use in microorganisms such as microalgae are found in U.S. Pat. No. 7,081,567 (issued Jul. 25, 2006 to Xue et al.); U.S. Pat. No. 6,680,426 (issued Jan. 20, 2004 to Daniell et al.); and U.S. Pat. No. 5,693,507 (issued Dec. 2, 1997 to Daniell et al.).

Proteins expressed in the nuclear genome of *Chlorella* can be targeted to the chloroplast using chloroplast targeting signals. Chloroplast targeting sequences endogenous to *Chlorella* are known, such as genes in the *Chlorella* nuclear genome that encode proteins that are targeted to the chloroplast; see for example GenBank Accession numbers AY646197 and AF499684. Proteins can also be expressed in the *Chlorella* chloroplast by insertion of genes directly into the chloroplast genome. Chloroplast transformation typically occurs through homologous recombination, and can be performed if chloroplast genome sequences are known for creation of targeting vectors (see for example the complete genome sequence of a *Chlorella* chloroplast; Genbank accession number NC_001865). See previous sections herein for details of chloroplast transformation.

(2) Expression in Mitochondria

In another embodiment of the present invention, the expression of a polypeptide in a microorganism is targeted to mitochondria. Methods for targeting foreign gene products into mitochondria (Boutry et al. Nature (London) (1987) 328:340 342) have been described, including in green microalgae (see for example Mol Gen Genet. 1993 January; 236(2-3):235-44).

For example, an expression vector encoding a suitable secretion signal can target a heterologus protein to the mitochondrion. The IMPACTVECTOR1.5 vector, from Wageningen UR—Plant Research International, uses the yeast CoxIV secretion signal, which was shown to deliver proteins in the mitochondrial matrix. The protein is fused to the first 4 amino acids of the yeast CoxIV protein in order to allow proper processing of the signal peptide (Kohler et al. Plant J 11: 613-621 (1997)). Other mitochondrial targeting sequences are known, including those functional in green microalgae. For example, see FEBS Lett. 1990 Jan. 29; 260(2):165-8; and J Biol. Chem. 2002 Feb. 22; 277(8):6051-8.

Proteins expressed in the nuclear genome of *Chlorella* can be targeted to the mitochondria using mitochondrial targeting signals. See previous sections herein for details of mitochondrial protein targeting and transformation.

(3) Expression in Endoplasmic Reticulum

In another embodiment of the present invention, the expression of a polypeptide in a microorganism is targeted to the endoplasmic reticulum. The inclusion of an appropriate retention or sorting signal in an expression vector ensure that proteins are retained in the endoplasmic reticulum (ER) and do not go downstream into Golgi. For example, the IMPACTVECTOR1.3 vector, from Wageningen UR—Plant Research International, includes the well known KDEL retention or sorting signal. With this vector, ER retention has a practical advantage in that it has been reported to improve expression levels 5-fold or more. The main reason for this appears to be that the ER contains lower concentrations and/or different proteases responsible for post-translational degradation of expressed proteins than are present in the cytoplasm. ER retention signals functional in green microalgae are known. For example, see Proc Natl Acad Sci USA. 2005 Apr. 26; 102(17):6225-30.

While the methods and materials of the invention allow for the introduction of any exogenous gene into a microorganism, for example *Prototheca*, genes relating to sucrose utilization and lipid pathway modification are of particular interest, as discussed in the following sections.

IV. Selectable Markers

1. Sucrose Utilization

In embodiment, the recombinant *Prototheca* cell of the invention further contains one or more exogenous sucrose utilization genes. In various embodiments, the one or more genes encode one or more proteins selected from the group consisting of a fructokinase, a glucokinase, a hexokinase, a sucrose invertase, a sucrose transporter. For example, expression of a sucrose transporter and a sucrose invertase allows *Prototheca* to transport sucrose into the cell from the culture media and hydrolyze sucrose to yield glucose and fructose. Optionally, a fructokinase can be expressed as well in instances where endogenous hexokinase activity is insufficient for maximum phosphorylation of fructose. Examples of suitable sucrose transporters are Genbank accession numbers CAD91334, CAB92307, and CAA53390. Examples of suitable fructokinases are Genbank accession numbers P26984, P26420 and CAA43322.

In one embodiment, the present invention provides a *Prototheca* host cell that secretes a sucrose invertase. Secretion of a sucrose invertase obviates the need for expression of a transporter that can transport sucrose into the cell. This is because a secreted invertase catalyzes the conversion of a molecule of sucrose into a molecule of glucose and a molecule of fructose, both of which can be transported and utilized by microbes provided by the invention. For example, expression of a sucrose invertase (such as SEQ ID NO:3) with a secretion signal (such as that of SEQ ID NO: 4 (from yeast), SEQ ID NO: 5 (from higher plants), SEQ ID NO: 6 (eukaryotic consensus secretion signal), and SEQ ID NO: 7 (combination of signal sequence from higher plants and eukaryotic consensus) generates invertase activity outside the cell. Expression of such a protein, as enabled by the genetic engineering methodology disclosed herein, allows cells already capable of utilizing extracellular glucose as an energy source to utilize sucrose as an extracellular energy source.

*Prototheca* species expressing an invertase in media containing sucrose are a preferred microalgal species for the production of oil. The expression and extracellular targeting of this fully active protein allows the resulting host cells to grow on sucrose, whereas their non-transformed counterparts cannot. Thus, the present invention provides *Prototheca* recombinant cells with a codon-optimized invertase gene, including but not limited to the yeast invertase gene, integrated into their genome such that the invertase gene is expressed as assessed by invertase activity and sucrose hydrolysis. The present invention also provides invertase genes useful as selectable markers in *Prototheca* recombinant cells, as such cells are able to grow on sucrose, while their non-transformed counterparts cannot; and methods for selecting recombinant host cells using an invertase as a powerful, selectable marker for algal molecular genetics.

The successful expression of a sucrose invertase in *Prototheca* also illustrates another aspect of the present invention in that it demonstrates that heterologous (recombinant) proteins can be expressed in the algal cell and successfully transit outside of the cell and into the culture medium in a fully active and functional form. Thus, the present invention provides methods and reagents for expressing a wide and diverse array of heterologous proteins in microalgae and secreting them outside of the host cell. Such proteins include, for example, industrial enzymes such as, for example, lipases, proteases, cellulases, pectinases, amylases (e.g., SEQ ID NO: 190-191), esterases, oxidoreductases, transferases, lactases, isomerases, and invertases, as well as therapeutic proteins such as, for example, growth factors, cytokines, full length antibodies comprising two light and two heavy chains, Fabs, scFvs (single chain variable fragment), camellid-type antibodies, antibody fragments, antibody fragment-fusions, antibody-receptor fusions, insulin, interferons, and insulin-like growth factors.

The successful expression of a sucrose invertase in *Prototheca* also illustrates another aspect of the present invention in that it provides methods and reagents for the use of fungal transit peptides in algae to direct secretion of proteins in *Prototheca*; and methods and reagents for determining if a peptide can function, and the ability of it to function, as a transit peptide in *Prototheca* cells. The methods and reagents of the invention can be used as a tool and platform to identify other transit peptides that can successfully traffic proteins outside of a cell, and that the yeast invertase has great utility in these methods. As demonstrated in this example, removal of the endogenous yeast invertase transit peptide and its replacement by other transit peptides, either endogenous to the host algae or from other sources (eukaryotic, prokaryotic and viral), can identify whether any peptide of interest can function as a transit peptide in guiding protein egress from the cell.

Examples of suitable sucrose invertases include those identified by Genbank accession numbers CAB95010, NP_012104 and CAA06839. Non-limiting examples of suitable invertases are listed below in Table 3 Amino acid sequences for each listed invertase are included in the Sequence Listing below. In some cases, the exogenous sucrose utilization gene suitable for use in the methods and vectors of the invention encodes a sucrose invertase that has at least 40, 50, 60, 75, or 90% or higher amino acid identity with a sucrose invertase selected from Table 3.

TABLE 3

Sucrose invertases.

| Description | Organism | GenBank Accession No. | SEQ ID NO: |
|---|---|---|---|
| Invertase | Chicorium intybus | Y11124 | SEQ ID NO: 20 |
| Invertase | Schizosaccharomyces pombe | AB011433 | SEQ ID NO: 21 |
| beta-fructo-furanosidase (invertase) | Pichia anomala | X80640 | SEQ ID NO: 22 |
| Invertase | Debaryomyces occidentalis | X17604 | SEQ ID NO: 23 |
| Invertase | Oryza sativa | AF019113 | SEQ ID NO: 24 |
| Invertase | Allium cepa | AJ006067 | SEQ ID NO: 25 |
| Invertase | Beta vulgaris subsp. Vulgaris | AJ278531 | SEQ ID NO: 26 |
| beta-fructo-furanosidase (invertase) | Bifidobacterium breve UCC2003 | AAT28190 | SEQ ID NO: 27 |
| Invertase | Saccharomyces cerevisiae | NP_012104 | SEQ ID NO: 8 (nucleotide) SEQ ID NO: 28 (amino acid) |
| Invertase A | Zymomonas mobilis | AAO38865 | SEQ ID NO: 29 |
| Invertase | Arabadopsis thaliana | NP_566464 | SEQ ID NO: 188 |

The secretion of an invertase to the culture medium by *Prototheca* enable the cells to grow as well on waste molasses from sugar cane processing as they do on pure reagent-grade glucose; the use of this low-value waste product of sugar cane processing can provide significant cost savings in the production of lipids and other oils. Thus, the present invention provides a microbial culture containing a population of *Prototheca* microorganisms, and a culture medium comprising (i) sucrose and (ii) a sucrose invertase enzyme. In various embodiments the sucrose in the culture comes from sorghum, sugar beet, sugar cane, molasses, or depolymerized cellulosic material (which may optionally contain lignin). In another aspect, the methods and reagents of the invention significantly increase the number and type of feedstocks that can be utilized by recombinant *Prototheca*. While the microbes exemplified here are altered such that they can utilize sucrose, the methods and reagents of the invention can be applied so that feedstocks such as cellulosics are utilizable by an engineered host microbe of the invention with the ability to secrete cellulases, pectinases, isomerases, or the like, such that the breakdown products of the enzymatic reactions are no longer just simply tolerated but rather utilized as a carbon source by the host. An example of this is described below and in the Examples of microbes engineered to express a secretable α-galactosidase, conferring the ability to hydrolyze α-galactosyl bonds in oligosaccharides such as those contained in raffinose and stachyose which are two oligosaccharides found in agricultural waste streams.

2. Alpha-galactosidase Expression

While the expression of a sucrose invertase, as described above, confers the ability for *Prototheca* cells to more efficiently utilize sucrose as a carbon source (via the enzyme hydrolyzing the α-linkage between fructose and glucose molecules in the disaccharide sucrose), the expression of other enzymes that hydrolyze other types of α-linkages in oligosaccharides can confer the ability for *Prototheca* cells to utilize other carbon sources. The expression of these enzymes (and the resulting ability to utilize carbon sources that *Prototheca* and other microalgal cells ordinarily would not be able to) can be used as a selectable marker for these transgenic *Prototheca* cells by allowing for the selection of positive clones that are able to grow on these carbon sources.

In an embodiment, the recombinant *Prototheca* cell of the invention further contains one or more exogenous genes encoding polysaccharide-degrading enzymes. In various embodiments, the one or more genes encoding a polysaccharide-degrading enzyme is a gene encoding a secreted α-galactosidase. The expression of an exogenous secreted α-galactosidase in a *Prototheca* cell confers the ability of such transformed strains to grow on sugars (carbon sources) containing D-galactosyl linkages, such as α-linkages between galactose and glucose monosaccharide units. *Prototheca* strains expressing an exogenous, secreted α-galactosidase will be able to utilize disaccharides such as melibiose (disaccharide composed of α-D-galactose-glucose).

Sugars such as raffinose (a trisaccharide comprised of α-linked galactose-glucose-fructose) and stachyose (a tetrasaccharide composed to two α-linked D-galactose units, followed by α-linked glucose and fructose) are present in significant proportions in agricultural waste streams such as beet pulp (raffinose) and soybean meal (stachyose). Such agricultural residues represent a significant untapped carbon source for the conversion into oil by microbes (including *Prototheca*) capable of utilizing them.

*Prototheca* strains are unable to utilize oligosaccharides such as raffinose and stachyose in any significant quantity or at all. In the case of raffinose and stachyose, although transgenic strains expressing a sucrose invertase (as described above) have the ability to hydrolyze the α-linkage between fructose and glucose in α-galactosyl derivatives of sucrose, but the remainder of the oligosaccharide remains unutilized, as sucrose invertase will not cleave the remaining α-linkages in such sugars and the resulting disaccharides are not utilizable. In another embodiment, the recombinant *Prototheca* cell of the invention comprises both an exogenous gene encoding a sucrose invertase and an exogenous gene encoding an α-galactosidase. Thus, strains expressing both a sucrose invertase and an α-galactosidase will be capable of fully hydrolyzing oligosaccharides such as raffinose and stachyose, enabling the consumption of the component monomers. In addition, α-galactosidase encoding genes may be used as a selectable marker for transformation. Clones containing the exogenous α-galactosidase gene will have the ability to grow on melibiose. Examples of suitable α-galactosidase genes for use in *Prototheca* strains include the MEL1 gene from *Saccharomyces carlbergensis*, the AglC gene from *Aspergilus niger*. Interestingly, not all α-galactosidase genes are functional in *Prototheca* species, even if the genes are optimized according to the preferred codon usage in *Prototheca* strains. The Examples below demonstrates the ability of transgenic *Prototheca* cells to grow on melibiose when transformed with codon-optimized MEL1 gene from *S. carlbergensis* and the AglC gene from *A. niger*, but not an α-galactosidase encoding gene from the higher plant, *Cyamopsis tetragonobola* (Guar bean).

3. Thiamine Auxotrophy Complementation

*Prototheca* strains including *Prototheca moriformis* are known to be thiamine auxotrophic (See, for example, Ciferri, O. (1956) *Nature*, v. 178, pp. 1475-1476), meaning that these strains require thiamine in the nutrient media for growth Thiamine auxotrophy can be the result of mutations or lack of expression of enzymes in the thiamine biosynthetic pathway. Complemented transgenic strains expressing the missing enzyme(s) in the thiamine biosynthetic pathway can then be grown without added thiamine, thus reducing the cost of the nutrient media as well as rendering the resulting microalgal biomass more desirable from an animal nutrition perspective. Complementation with a thiamine biosynthetic pathway enzyme can also be used as a selectable marker as the transgenic gene confers the ability to grow on plates/media that does not contain thiamine.

In an embodiment, the recombinant *Prototheca* cell of the invention further contains one or more exogenous genes encoding thiamine biosynthetic pathway enzyme. In another embodiment, the recombinant *Prototheca* cell of the invention comprises an exogenous gene encoding hydroxymethylpyrimidine phosphate synthases (e.g., SEQ ID NO: 192) from algal, plant or cyanobacterial sources. In still other embodiments, the hydroxymethylpyrimidine phosphate synthase is encoded by a THIC gene. In still other embodiments, the THIC gene is the *Coccomyxa* C-169 THIC, *Arabidopsis thaliana* THIC, the *Synechocystis* sp. PCC 6803 THIC, or the *Salmonella enterica* subsp. *enterica* serovar *Typhimurium* str.THIC (SEQ ID NO: 193). The Examples below details the engineering of *Prototheca moriformis* UTEX 1435 with restored thiamine prototrophy.

4. Other Selectable Markers

Any of a wide variety of selectable markers can be employed in a transgene construct useful for transforming microorganisms, such as *Chlorella*. Examples of suitable selectable markers include the nitrate reductase gene, the hygromycin phosphotransferase gene (HPT), the neomycin phosphotransferase gene, and the ble gene, which confers resistance to phleomycin. Methods of determining sensitivity of microalgae to antibiotics are well known. For example, Mol Gen Genet. 1996 Oct. 16; 252(5):572-9.

More specifically, Dawson et al. (1997), Current Microbiology 35:356-362 (incorporated by reference herein in its entirety), described the use of the nitrate reductase (NR) gene from *Chlorella vulgaris* as a selectable marker for NR-deficient *Chlorella sorokiniana* mutants. Kim et al. (2002), Mar. Biotechnol. 4:63-73 (incorporated by reference herein in its entirety), disclosed the use of the HPT gene as a selectable marker for transforming *Chorella ellipsoidea*. Huang et al. (2007), Appl. Microbiol. Biotechnol. 72:197-205 (incorporated by reference herein in its entirety), reported on the use of Sh ble as a selectable marker for *Chlorella* sp. DT.

V. Lipid Pathway Engineering

In addition to altering the ability of microorganisms (e.g., microalgae, oleaginous yeast, fungi, or bacteria), such as

*Prototheca* to utilize feedstocks such as sucrose-containing feedstocks, the present invention also provides recombinant microorganisms (e.g., *Prototheca*) that have been modified to alter the properties and/or proportions of lipids produced. The pathway can further, or alternatively, be modified to alter the properties and/or proportions of various lipid molecules produced through enzymatic processing of lipids and intermediates in the fatty acid pathway. In various embodiments, the recombinant microorganisms (e.g., *Prototheca* cells) of the invention have, relative to their untransformed counterparts, optimized lipid yield per unit volume and/or per unit time, carbon chain length (e.g., for renewable diesel production or for industrial chemicals applications requiring lipid feedstock), reduced number of double or triple bonds, optionally to zero, and increasing the hydrogen:carbon ratio of a particular species of lipid or of a population of distinct lipid. In addition, microorganisms that produce desirable hydrocarbons can be engineered to produce such components in higher quantities, or with greater specificity.

In the case of microalgae, some wild-type cells already have good growth characteristics but do not produce the desired types or quantities of lipids. Examples include, without limitation, *Pyrobotrys, Phormidium, Agmenellum, Carteria, Lepocinclis, Pyrobotrys, Nitzschia, Lepocinclis, Anabaena, Euglena, Spirogyra, Chlorococcum, Tetraedron, Oscillatoria, Phagus,* and *Chlorogonium*, which have the desirable growth characteristic of growing in municipal sewage or wastewater. Such cells, as well as species of *Chlorella, Prototheca* and other microbes, can be engineered to have improved lipid production characteristics. Desired characteristics include optimizing lipid yield per unit volume and/or per unit time, carbon chain length (e.g., for biodiesel production or for industrial applications requiring hydrocarbon feedstock), reducing the number of double or triple bonds, optionally to zero, removing or eliminating rings and cyclic structures, and increasing the hydrogen:carbon ratio of a particular species of lipid or of a population of distinct lipid. In addition, microalgae that produce appropriate hydrocarbons can also be engineered to have even more desirable hydrocarbon outputs. Examples of such microalgae include species of the genus *Chlorella* and the genus *Prototheca*.

In particular embodiments, one or more key enzymes that control branch points in metabolism to fatty acid synthesis have been up-regulated or down-regulated to improve lipid production. Up-regulation can be achieved, for example, by transforming cells with expression constructs in which a gene encoding the enzyme of interest is expressed, e.g., using a strong promoter and/or enhancer elements that increase transcription. Such constructs can include a selectable marker such that the transformants can be subjected to selection, which can result in amplification of the construct and an increase in the expression level of the encoded enzyme. Examples of enzymes suitable for up-regulation according to the methods of the invention include pyruvate dehydrogenase, which plays a role in converting pyruvate to acetyl-CoA (examples, some from microalgae, include Genbank accession numbers NP_415392; AAA53047; Q1XDM1; and CAF05587). Up-regulation of pyruvate dehydrogenase can increase production of acetyl-CoA, and thereby increase fatty acid synthesis. Acetyl-CoA carboxylase catalyzes the initial step in fatty acid synthesis. Accordingly, this enzyme can be up-regulated to increase production of fatty acids (examples, some from microalgae, include Genbank accession numbers BAA94752; AAA75528; AAA81471; YP_537052; YP_536879; NP_045833; and BAA57908). Fatty acid production can also be increased by up-regulation of acyl carrier protein (ACP), which carries the growing acyl chains during fatty acid synthesis (examples, some from microalgae, include Genbank accession numbers A0T0F8; P51280; NP_849041; YP_874433). Glycerol-3-phosphate acyltransferase catalyzes the rate-limiting step of fatty acid synthesis. Up-regulation of this enzyme can increase fatty acid production (examples, some from microalgae, include Genbank accession numbers AAA74319; AAA33122; AAA37647; P44857; and ABO94442).

Up- and/or down-regulation of genes can be applied to global regulators controlling the expression of the genes of the fatty acid biosynthetic pathways. Accordingly, one or more global regulators of fatty acid synthesis can be up- or down-regulated, as appropriate, to inhibit or enhance, respectively, the expression of a plurality of fatty acid synthetic genes and, ultimately, to increase lipid production. Examples include sterol regulatory element binding proteins (SREBPs), such as SREBP-1a and SREBP-1c (for examples see Genbank accession numbers NP_035610 and Q9WTN3).

The present invention also provides recombinant microorganisms (e.g., *Prototheca* cells) that have been modified to contain one or more exogenous genes encoding lipid modification enzymes such as, for example, fatty acyl-ACP thioesterases (e.g., *C. callophylla* (SEQ ID NO: 145 and SEQ ID NO: 146; see also Table 4), fatty acyl-CoA/aldehyde reductases (see Table 6), fatty acyl-CoA reductases (see Table 7), fatty aldehyde decarbonylase (see Table 8), fatty aldehyde reductases, desaturases (such as stearoyl-ACP desaturases (e.g., a codon optimized *R. communis* SAD, SEQ ID NO: 147 and SEQ ID NO: 148) and fatty acyl desaturases and squalene synthases (see GenBank Accession number AF205791). In some embodiments, genes encoding a fatty acyl-ACP thioesterase and a naturally co-expressed acyl carrier protein are transformed into a *Prototheca* cell, optionally with one or more genes encoding other lipid modification enzymes. In other embodiments, the ACP and the fatty acyl-ACP thioesterase may have an affinity for one another that imparts an advantage when the two are used together in the microbes and methods of the present invention, irrespective of whether they are or are not naturally co-expressed in a particular tissue or organism. Thus, the present invention contemplates both naturally co-expressed pairs of these enzymes as well as those that share an affinity for interacting with one another to facilitate cleavage of a length-specific carbon chain from the ACP.

In still other embodiments, an exogenous gene encoding a desaturase is transformed into the microorganism (e.g., a *Prototheca* cell) in conjunction with one or more genes encoding other lipid modification enzymes to provide modifications with respect to lipid saturation. In other embodiments, an endogenous desaturase gene is overexpressed (e.g., through the introduction of additonal copies off the gene) in the microorganism (e.g., a *Prototheca* cell). Stearoyl-ACP desaturase (see, e.g., GenBank Accession numbers AAF15308; ABM45911; and AAY86086), for example, catalyzes the conversion of stearoyl-ACP to oleoyl-ACP. Up-regulation of this gene can increase the proportion of monounsaturated fatty acids produced by a cell; whereas down-regulation can reduce the proportion of monounsaturates. For illustrative purposes, stearoyl-ACP desaturases (SAD) are responsible for the synthesis of C18:1 fatty acids from C18:0 precursors. Another family of desaturases are the fatty acyl desaturases (FAD), including delta 12 fatty acid desaturases (Δ12 FAD). These desaturases also provide modifications with respect to lipid saturation. For illustrative purposes, delta 12 fatty acid desaturases are responsible for the synthesis of C18:2 fatty acids from C18:1 precursors. Similarly, the expression of one or more glycerolipid desaturases can be controlled to alter the ratio of unsaturated to saturated fatty acids such as ω-6 fatty acid desaturase, ω-3 fatty acid desaturase, or ω-6-oleate desaturase. In some embodiments, the desaturase can be selected with reference to a desired carbon chain length, such that the desaturase is capable of making location specific modifications within a specified carbon-length substrate, or substrates having a carbon-length within a specified range. In another embodiment, if the desired fatty acid profile is an increase in monounsaturates (such as C16:1 and/or C18:1) overexpression of a SAD or expression of a heterologous SAD can be coupled with the silencing or inactivation (e.g., through mutation, RNAi, knockout of an endogenous desaturase gene, etc.) of a fatty acyl desaturase (FAD).

In other embodiments, the microorganism (e.g., *Prototheca* cell) has been modified to have a mutated endogenous desaturase gene, wherein the mutation renders the gene or desaturase enzyme inactive. In some cases, the mutated endogenous desaturase gene is a fatty acid desaturase (FAD). In other cases, the mutated endogenous desaturase gene is a stearoyl Acyl carrier protein desaturase (SAD). Example 11 below describes the targeted ablation or knockout of stearoyl-ACP desaturases and delta 12 fatty acid desaturases.

In some cases, it may be advantageous to pair one or more of the genetic engineering techniques in order to achieve a trangenic cell that produces the desired lipid profile. In one embodiment, a microorganism (e.g., a *Prototheca* cell) comprises a mutated endogenous desaturase gene and one or more exogenous gene. In non-limiting examples, a *Prototheca* cell with a mutated endogenous desaturase gene can also express an exogenous fatty acyl-ACP thioesterase gene and/or a sucrose invertase gene. Example 11 below describes a transgenic *Prototheca* cell containing a targeted ablation or knockout of an endogenous SAD and also expresses a *Cinnamomum camphora* C14-preferring thioesterase and a sucrose invertase. In this case, the transgenic *Prototheca* cell produces a lipid profile that closely approximates the lipid profile found in tallow. Tallow is typically derived from rendered beef or mutton fat, is solid at room temperature and is utilized in a variety of applications in the food, cosmetics, and chemicals industries. The fatty acid profile of tallow is: 4% C14:0; 26% C16:0; 3% C16:1; 14% C18:0; 41% C18:1; 3% C18:2; and 1% C18:3. As is shown in Example 11 below, clones of transgenic *Prototheca* cells with a targeted ablation or knockout of an endogenous SAD and expressing a *C. camphora* C14-preferring thioesterase have lipid profiles of: less than 1% C12 and shorter carbon chain length fatty acids; 2.74% to 6.13% C14:0; 23.07% to 25.69% C16:0; 7.02% to 11.08% C18:0; 42.03% to 51.21% C18:1; and 9.37% to 13.45% C18:2 (expressed in area percent). In some cases, the transgenic *Prototheca* cells have lipid profiles of: 3-5% C14:0; 25-27% C16:0; 10-15% C18:0; and 40-45% C18:1.

Thus, in particular embodiments, microbes of the present invention are genetically engineered to express one or more exogenous genes selected from an acyl-ACP thioesterase, an acyl-CoA/aldehyde reductase, a fatty acyl-CoA reductase, a fatty aldehyde reductase, a fatty aldehyde decarbonylase, or a naturally co-expressed acyl carrier protein. Suitable expression methods are described above with respect to the expression of a lipase gene, including, among other methods, inducible expression and compartmentalized expression. A fatty acyl-ACP thioesterase cleaves a fatty acid from an acyl carrier protein (ACP) during lipid synthesis. Through further enzymatic processing, the cleaved fatty acid is then combined with a coenzyme to yield an acyl-CoA molecule. This acyl-CoA is the substrate for the enzymatic activity of a fatty acyl-CoA reductase to yield an aldehyde, as well as for a fatty acyl-CoA/aldehyde reductase to yield an alcohol. The aldehyde produced by the action of the fatty acyl-CoA reductase identified above is the substrate for further enzymatic activity by either a fatty aldehyde reductase to yield an alcohol, or a fatty aldehyde decarbonylase to yield an alkane or alkene.

In some embodiments, fatty acids, glycerolipids, or the corresponding primary alcohols, aldehydes, alkanes or alkenes, generated by the methods described herein, contain 8, 10, 12, or 14 carbon atoms. Preferred fatty acids for the production of diesel, biodiesel, renewable diesel, or jet fuel, or the corresponding primary alcohols, aldehydes, alkanes and alkenes, for industrial applications contain 8 to 14 carbon atoms. In certain embodiments, the above fatty acids, as well as the other corresponding hydrocarbon molecules, are saturated (with no carbon-carbon double or triple bonds); mono unsaturated (single double bond); poly unsaturated (two or more double bonds); are linear (not cyclic) or branched. For fuel production, greater saturation is preferred.

The enzymes described directly above have a preferential specificity for hydrolysis of a substrate containing a specific number of carbon atoms. For example, a fatty acyl-ACP thioesterase may have a preference for cleaving a fatty acid having 12 carbon atoms from the ACP. In some embodiments, the ACP and the length-specific thioesterase may have an affinity for one another that makes them particularly useful as a combination (e.g., the exogenous ACP and thioesterase genes may be naturally co-expressed in a particular tissue or organism from which they are derived). Therefore, in various embodiments, the recombinant *Prototheca* cell of the invention can contain an exogenous gene that encodes a protein with specificity for catalyzing an enzymatic activity (e.g., cleavage of a fatty acid from an ACP, reduction of an acyl-CoA to an aldehyde or an alcohol, or conversion of an aldehyde to an alkane) with regard to the number of carbon atoms contained in the substrate. The enzymatic specificity can, in various embodiments, be for a substrate having from 8 to 34 carbon atoms, preferably from 8 to 18 carbon atoms, and more preferably from 8 to 14 carbon atoms. A preferred specificity is for a substrate having fewer, i.e., 12, rather than more, i.e., 18, carbon atoms.

Other fatty acyl-ACP thioesterases suitable for use with the microbes and methods of the invention include, without limitation, those listed in Table 4.

TABLE 4

Fatty acyl-ACP thioesterases and GenBank accession numbers.

*Umbellularia californica* fatty acyl-ACP thioesterase (GenBank #AAC49001) (SEQ ID NO: 203)
*Cinnamomum camphora* fatty acyl-ACP thioesterase (GenBank #Q39473)
*Umbellularia californica* fatty acyl-ACP thioesterase (GenBank #Q41635)
*Myristica fragrans* fatty acyl-ACP thioesterase (GenBank #AAB71729) (SEQ ID NO: 224)
*Myristica fragrans* fatty acyl-ACP thioesterase (GenBank #AAB71730) (SEQ ID NO: 222)
*Elaeis guineensis* fatty acyl-ACP thioesterase (GenBank #ABD83939) (SEQ ID NO: 204)
*Elaeis guineensis* fatty acyl-ACP thioesterase (GenBank #AAD42220)
*Populus tomentosa* fatty acyl-ACP thioesterase (GenBank #ABC47311) (SEQ ID NO: 207)
*Arabidopsis thaliana* fatty acyl-ACP thioesterase (GenBank #NP_172327) (SEQ ID NO: 208)

TABLE 4-continued

Fatty acyl-ACP thioesterases and GenBank accession numbers.

*Arabidopsis thaliana* fatty acyl-ACP thioesterase (GenBank #CAA85387) (SEQ ID NO: 209)
*Arabidopsis thaliana* fatty acyl-ACP thioesterase (GenBank #CAA85388) (SEQ ID NO: 210)
*Gossypium hirsutum* fatty acyl-ACP thioesterase (GenBank #Q9SQI3) (SEQ ID NO: 211)
*Cuphea lanceolata* fatty acyl-ACP thioesterase (GenBank #CAA54060) (SEQ ID NO: 212)
*Cuphea hookeriana* fatty acyl-ACP thioesterase (GenBank #AAC72882) (SEQ ID NO: 202)
*Cuphea calophylla* subsp. *mesostemon* fatty acyl-ACP thioesterase (GenBank #ABB71581) (SEQ ID NO: 213)
*Cuphea lanceolata* fatty acyl-ACP thioesterase (GenBank #CAC19933)
*Elaeis guineensis* fatty acyl-ACP thioesterase (GenBank #AAL15645) (SEQ ID NO: 206)
*Cuphea hookeriana* fatty acyl-ACP thioesterase (GenBank #Q39513)
*Gossypium hirsutum* fatty acyl-ACP thioesterase (GenBank #AAD01982) (SEQ ID NO: 214)
*Vitis vinifera* fatty acyl-ACP thioesterase (GenBank #CAN81819) (SEQ ID NO: 215)
*Garcinia mangostana* fatty acyl-ACP thioesterase (GenBank #AAB51525)
*Brassica juncea* fatty acyl-ACP thioesterase (GenBank #ABI18986) (SEQ ID NO: 216)
*Madhuca longifolia* fatty acyl-ACP thioesterase (GenBank #AAX51637) (SEQ ID NO: 217)
*Brassica napus* fatty acyl-ACP thioesterase (GenBank #ABH11710)
*Oryza sativa* (*indica* cultivar-group) fatty acyl-ACP thioesterase (GenBank #EAY86877) (SEQ ID NO: 218)
*Oryza sativa* (*japonica* cultivar-group) fatty acyl-ACP thioesterase (GenBank #NP_001068400) (SEQ ID NO: 219)
*Oryza sativa* (*indica* cultivar-group) fatty acyl-ACP thioesterase (GenBank #EAY99617) (SEQ ID NO: 220)
*Cuphea hookeriana* fatty acyl-ACP thioesterase (GenBank #AAC49269)
*Ulmus Americana* fatty acyl-ACP thioesterase (GenBank #AAB71731)
*Cuphea lanceolata* fatty acyl-ACP thioesterase (GenBank #CAB60830) (SEQ ID NO: 221)
*Cuphea palustris* fatty acyl-ACP thioesterase (GenBank #AAC49180)
*Iris germanica* fatty acyl-ACP thioesterase (GenBank #AAG43858)
*Iris germanica* fatty acyl-ACP thioesterase (GenBank #AAG43858.1)
*Cuphea palustris* fatty acyl-ACP thioesterase (GenBank #AAC49179)
*Myristica fragrans* fatty acyl-ACP thioesterase (GenBank# AAB71729)
*Myristica fragrans* fatty acyl-ACP thioesterase (GenBank# AAB717291.1)
*Cuphea hookeriana* fatty acyl-ACP thioesterase (GenBank #U39834) (SEQ ID NO: 197)
*Umbelluaria californica* fatty acyl-ACP thioesterase (GenBank # M94159) (SEQ ID NO: 285)
*Cinnamomum camphora* fatty acyl-ACP thioesterase (GenBank #U31813) (SEQ ID NO: 223)
*Cuphea wrightii* fatty acyl-ACOP thioesterase (GenBank #U56103) (SEQ ID NO: 183)
*Ricinus communis* fatty acyl-ACP thioesterase (GenBank #ABS30422) (SEQ ID NO: 198)

The Examples below describe the successful targeting and expression of heterologous fatty acyl-ACP thioesterases from *Cuphea hookeriana*, *Umbellularia californica*, *Cinnamomun camphora*, *Cuphea palustris*, *Cuphea lanceolata*, *Iris germanica*, *Myristica fragrans* and *Ulmus americana* in *Prototheca* species. Additionally, alterations in fatty acid profiles were confirmed in the host cells expression these heterologous fatty acyl-ACP thioesterases. These results were quite unexpected given the lack of sequence identity between algal and higher plant thioesterases in general, and between *Prototheca moriformis* fatty acyl-ACP thioesterase and the above listed heterologous fatty acyl-ACP thioesterases. As shown in the Examples, the expression of these heterologous thioesterases in *Prototheca* generates a transgenic microalgae that is able to produce oil/lipids with truly unique fatty acid profiles that are currently not available from commercial seed crops, even through the blending of several seed crop oils. Table 5 shows the fatty acid profiles of common commercial seed oils. All commercial seed oil data below were compiled from the US Pharmacopeias Food and Chemicals Codes, 7th Ed. 2010-2011. Tallow data is from the National Research Council: Fat Content and Composition of Animal Products (1976).

TABLE 5

Lipid profiles of commercial seed oils (in percentages).

| | C8:0 | C10:0 | C12:0 | C14:0 | C16:0 | C18:0 | C18:1 | C18:0-diOH | C18:1-OH | C18:2 | C18:3 α |
|---|---|---|---|---|---|---|---|---|---|---|---|
| *R. communis* (Castor oil) | 0 | 0 | 0 | 0 | 0.9-1.6 | 1.0-1.8 | 3.7-6.7 | 0.4-1.3 | 83.6-89.0 | 0 | 0.2-0.6 |
| *C. nucifera* (Coconut oil) | 5.0-9.0 | 4.0-8.0 | 44-52 | 15-21 | 8.0-11.0 | 1.0-4.0 | 5.0-8.0 | 0 | 0 | 0-2.5 | 0 |
| *Z. mays* (Corn oil) | 0 | 0 | 0 | <1.0 | 8.0-19.0 | 0.5-4.0 | 19-50 | 0 | 0 | 38-65 | <2.0 |
| *G. barbadense* (Cottonseed oil) | 0 | 0 | <0.1 | 0.5-2.0 | 17-29 | 1.0-4.0 | 13-44 | 0 | 0 | 40-63 | 0.1-2.1 |
| *B. rapa*, *B. napus*, *B. juncea* (Canola) | 0 | 0 | <0.1 | <0.2 | <6.0 | <2.5 | >50 | 0 | 0 | <40 | <14 |
| *O. europea* (Olive) | 0 | 0 | 0 | <0.1 | 6.5-20.0 | 0.5-5.0 | 56-85 | 0 | 0 | 3.5-20.0 | <1.2 |
| *A. hypogaea* (Peanut) | 0 | 0 | <0.1 | <0.2 | 7.0-16.0 | 1.3-6.5 | 35-72 | 0 | 0 | 13.0-43 | <0.6 |
| *E. guineensis* (Palm kernel) | 3.0-5.0 | 2.5-6.0 | 40-52 | 14.0-18.0 | 7.0-10.0 | 1.0-3.0 | 11.0-19.0 | 0 | 0 | 0.5-4.0 | 0 |

TABLE 5-continued

Lipid profiles of commercial seed oils (in percentages).

| | C8:0 | C10:0 | C12:0 | C14:0 | C16:0 | C18:0 | C18:1 | C18:0-diOH | C18:1-OH | C18:2 | C18:3 α |
|---|---|---|---|---|---|---|---|---|---|---|---|
| *E. guineensis* (Palm) | 0 | 0 | 0 | 0.5-5.9 | 32.0-47.0 | 2.0-8.0 | 34-44 | 0 | 0 | 7.2-12.0 | 0 |
| *C. tinctorus* (Safflower) | 0 | 0 | <0.1 | <0.1 | 2.0-10.0 | 1.0-10.0 | 7.0-16.0 | 0 | 0 | 72-81 | <1.5 |
| *H. annus* (Sunflower) | 0 | 0 | <0.1 | <0.5 | 3.0-10.0 | 1.0-10.0 | 14-65 | 0 | 0 | 20-75 | <0.5 |
| *G. max* (Soybean) | 0 | 0 | <0.1 | <0.5 | 7.0-12.0 | 2.0-5.5 | 19-30 | 0 | 0 | 48-65 | 5.0-10.0 |
| *L. usitatissimum* (Solin-Flax) | 0 | 0 | <0.1 | <0.5 | 2.0-9.0 | 2.0-5.0 | 8.0-60 | 0 | 0 | 40-80 | <5.0 |
| *B. parkii* (Sheanut) | 0 | 0 | 0 | 0 | 3.8-4.1 | 41.2-56.8 | 34.0-46.9 | 0 | 0 | 3.7-6.5 | 0 |
| Cocoa Butter | | 0-1 | 0-1 | 0-4 | 22-30 | 24-37 | 29-38 | | | 0-3 | |
| Tallow | | | | 3-4 | 23-28 | 14-23 | 36-43 | | | 1-4 | <1 |
| Lard | | | | 1-2 | 22-26 | 13-18 | 39-45 | | | 8-15 | 0.5-1.5 |

As an example, none of these common seed oils contain high amounts of C8 or C10 fatty acids, with coconut oil and palm kernel oil being the largest sources, but both a ratio of 1:1 (C8:C10 fatty acids). As shown in the Examples, *Prototheca* transformed with *Cuphea palustris* C:8 preferring thioesterase was able to achieve not only a C8 fatty acid levels of over 12%, but also, the ratio of C8:C10 fatty acids were about a 5:1. Changes in fatty acid levels are useful for producing oils containing a tailored fatty acid profile for a variety of commercial applications. Additionally, changes of ratios between different fatty acid chain lengths is something has not been available commercially in oils that have not been through further costly chemical processes (such as esterification, distillation, fractionation, and re-esterification). As another example, palm oil is the highest C16:0 fatty acid (32-47%) containing oils, but palm oil has very little C14:0 fatty acids. *Prototheca* containing the *U. americana* thioesterase achieved about 33-38% C16:0 fatty acids and about a 10-16% C14:0 fatty acids (about a 2:1 C16:0 to C14:0 ratio). This fatty acid profile is unachievable through blending of existing oils at a commercial level because the seed oils that are high in 16:0 fatty acids usually do not contain much 14:0 fatty acids.

The Examples below also describe, for the first time, the successful targeting and expression of at least two fatty acyl-ACP thioesterases in one clone. The alterations in the fatty acid profiles were confirmed in these clones and depending on which two thioesterases were co-expressed in one clone, the fatty acid profiles were impacted in different ways. As an example, from Table 5 above, both coconut oil and palm kernel oil have C12:C14 ratios of roughly 3:1. As described in the Examples below, a *Prototheca* transformant containing two heterologous thioesterase genes was able to produce C12:C14 fatty acid levels at a ratio of roughly 5:1. This kind of ratio of C12:C14 fatty acids has been, up to now, unachievable at commercial levels (i.e., through blending of seed oils).

Another novel aspect of the oils produced by transgenic microalgae is the degree of saturation of the fatty acids. Palm oil is currently the largest source of saturated oil, with a total saturates to unsaturates of 52% to 48%. As shown in the Examples below, *Prototheca* with heterologous thioesterases from *U. americana* and *C. camphora* achieved total saturates levels of over 60% in the oil that it produced. Also shown in the Examples below, *Prototheca* with heterologous thioesterase from *U. americana* achieved total saturates level of over 86% in the oil that it produced.

Fatty acyl-CoA/aldehyde reductases suitable for use with the microbes and methods of the invention include, without limitation, those listed in Table 6.

TABLE 6

Fatty acyl-CoA/aldehyde reductases listed by GenBank accession numbers.

AAC45217, YP_047869, BAB85476, YP_001086217, YP_580344, YP_001280274, YP_264583, YP_436109, YP_959769, ZP_01736962, ZP_01900335, ZP_01892096, ZP_01103974, ZP_01915077, YP_924106, YP_130411, ZP_01222731, YP_550815, YP_983712, YP_001019688, YP_524762, YP_856798, ZP_01115500, YP_001141848, NP_336047, NP_216059, YP_882409, YP_706156, YP_001136150, YP_952365, ZP_01221833, YP_130076, NP_567936, AAR88762, ABK28586, NP_197634, CAD30694, NP_001063962, BAD46254, NP_001030809, EAZ10132, EAZ43639, EAZ07989, NP_001062488, CAB88537, NP_001052541, CAH66597, CAE02214, CAH66590, CAB88538, EAZ39844, AAZ06658, CAA68190, CAA52019, and BAC84377

Fatty acyl-CoA reductases suitable for use with the microbes and methods of the invention include, without limitation, those listed in Table 7.

TABLE 7

Fatty acyl-CoA reductases listed by GenBank accession numbers.

NP_187805, ABO14927, NP_001049083, CAN83375, NP_191229, EAZ42242, EAZ06453, CAD30696, BAD31814, NP_190040, AAD38039, CAD30692, CAN81280, NP_197642, NP_190041, AAL15288, and NP_190042

Fatty aldehyde decarbonylases suitable for use with the microbes and methods of the invention include, without limitation, those listed in Table 8.

TABLE 8

Fatty aldehyde decarbonylases listed by GenBank accession numbers.

NP_850932, ABN07985, CAN60676, AAC23640, CAA65199, AAC24373, CAE03390, ABD28319, NP_181306, EAZ31322, CAN63491, EAY94825, EAY86731, CAL55686, XP_001420263, EAZ23849, NP_200588, NP_001063227, CAN83072, AAR90847, and AAR97643

Combinations of naturally co-expressed fatty acyl-ACP thioesterases and acyl carrier proteins are suitable for use with the microbes and methods of the invention.

Additional examples of hydrocarbon or lipid modification enzymes include amino acid sequences contained in, referenced in, or encoded by nucleic acid sequences contained or referenced in, any of the following U.S. Pat. Nos. 6,610,527; 6,451,576; 6,429,014; 6,342,380; 6,265,639; 6,194,185; 6,114,160; 6,083,731; 6,043,072; 5,994,114; 5,891,697; 5,871,988; 6,265,639, and further described in GenBank Accession numbers: AAO18435; ZP_00513891; Q38710; AAK60613; AAK60610; AAK60611; NP_113747; CAB75874; AAK60612; AAF20201; BAA11024; AF205791; and CAA03710.

Other enzymes in the lipid biosynthetic pathways are also suitable for use with microbes and methods of the invention. For example, keto acyl-ACP synthase (Kas) enzymes work in conjunction with some of the above listed enzymes in the lipid biosynthetic pathway. There different classes of Kas enzymes: Kas I participates in successive condensation steps between the ever-growing acyl ACP chains and malonyl-ACP. Kas II typically participates in the final condensation step leading from C16:0-ACP to C18:0-ACP incorporating malonyl-ACP. As such, in higher plants and some microalgae species/strains that synthesize predominantly C16-C18:0 fatty acids (and their unsaturated derivatives), Kas II enzymes interact with products of FatA genes (acyl-ACP thioesterases).

Acyl-ACP thioesterases are the terminators of higher plant (and some microalgal species) fatty acid biosynthesis, and in most plant species, this is carried out by members of the FatA gene family, whose role is to terminate elongation at the C16:0 to C18:0 stage. In species that synthesize shorter chain fatty acids (such as *Cuphea, Elaeis, Myristica*, or *Umbellularia*), a different group of acyl-ACP thioesterases encoded by FatB genes carry out this termination step (see e.g., the codon optimized coding region of *Cocos nucifera* FatB3-B, SEQ ID NO: 189). The interaction between Kas II enzymes and acyl-Acp thioesterases is important for the correct termination of fatty acid chain elongation. As a consequence, in higher plant species (and microalgal species) that have evolved FatB genes capable of shorter chain lipid biosynthesis, there has been a corresponding co-evolution of an additional class of Kas genes, termed Kas IV genes. Kas IV genes are responsible for chain length elongation of a specific size range of fatty acids, 4-14 carbons in length.

Other suitable enzymes for use with the microbes and the methods of the invention include those that have at least 70% amino acid identity with one of the proteins listed in Tables 4, 6-8, and that exhibit the corresponding desired enzymatic activity (e.g., cleavage of a fatty acid from an acyl carrier protein, reduction of an acyl-CoA to an aldehyde or an alcohol, or conversion of an aldehyde to an alkane). In additional embodiments, the enzymatic activity is present in a sequence that has at least about 75%, at least about 80%, at least about 85%, at least about 90%, at least about 95%, or at least about 99% identity with one of the above described sequences, all of which are hereby incorporated by reference as if fully set forth.

By selecting the desired combination of exogenous genes to be expressed, one can tailor the product generated by the microbe, which may then be extracted from the aqueous biomass. For example, the microbe can contain: (i) an exogenous gene encoding a fatty acyl-ACP thioesterase; and, optionally, (ii) a naturally co-expressed acyl carrier protein or an acyl carrier protein otherwise having affinity for the fatty acyl-ACP thioesterase (or conversely); and, optionally, (iii) an exogenous gene encoding a fatty acyl-CoA/aldehyde reductase or a fatty acyl-CoA reductase; and, optionally, (iv) an exogenous gene encoding a fatty aldehyde reductase or a fatty aldehyde decarbonylase. The microbe, under culture conditions described herein, synthesizes a fatty acid linked to an ACP and the fatty acyl-ACP thioesterase catalyzes the cleavage of the fatty acid from the ACP to yield, through further enzymatic processing, a fatty acyl-CoA molecule. When present, the fatty acyl-CoA/aldehyde reducatase catalyzes the reduction of the acyl-CoA to an alcohol. Similarly, the fatty acyl-CoA reductase, when present, catalyzes the reduction of the acyl-CoA to an aldehyde. In those embodiments in which an exogenous gene encoding a fatty acyl-CoA reductase is present and expressed to yield an aldehyde product, a fatty aldehyde reductase, encoded by the third exogenous gene, catalyzes the reduction of the aldehyde to an alcohol Similarly, a fatty aldehyde decarbonylase catalyzes the conversion of the aldehyde to an alkane or an alkene, when present.

In another embodiment, the microbe can contain: (i) an exogenous gene encoding a fatty acyl-ACP thioesterase; (ii) optionally, a naturally co-expressed acyl carrier protein or an acyl carrier protein having affinity for the fatty acid acyl-ACP thioesterase; (iii) a mutated endogenous desaturase gene, wherein the mutation renders the desaturase gene or desaturase protein inactive, such as a desaturase knockout; (iv) overexpression of an endogenous stearoyl acyl carrier protein desaturase or the expression of a heterologous SAD; and (v) any combination of the foregoing.

Genes encoding such enzymes, such as fatty acyl ACP thioesterases, can be obtained from cells already known to exhibit significant lipid production such as *Chlorella protothecoides*. Genes already known to have a role in lipid production, e.g., a gene encoding an enzyme that saturates double bonds, can be transformed individually into recipient cells. However, to practice the invention it is not necessary to make a priori assumptions as to which genes are required. Methods for identifiying genes that can alter (improve) lipid production in microalgae are described in PCT Pub. No. 2008/151149.

Thus, the present invention provides a microorganism (e.g., a *Prototheca* cell) that has been genetically engineered to express a lipid pathway enzyme at an altered level compared to a wild-type cell of the same species. In some cases, the cell produces more lipid compared to the wild-type cell when both cells are grown under the same conditions. In some cases, the cell has been genetically engineered and/or selected to express a lipid pathway enzyme at a higher level than the wild-type cell. In some cases, the lipid pathway enzyme is selected from the group consisting of pyruvate dehydrogenase, acetyl-CoA carboxylase, acyl carrier protein, and glycerol-3 phosphate acyltransferase. In some cases, the cell has been genetically engineered and/or selected to express a lipid pathway enzyme at a lower level than the wild-type cell. In at least one embodiment in which the cell expresses the lipid pathway enzyme at a lower level, the lipid pathway enzyme comprises citrate synthase.

In some embodiments, the cell has been genetically engineered and/or selected to express a global regulator of fatty acid synthesis at an altered level compared to the wild-type cell, whereby the expression levels of a plurality of fatty acid synthetic genes are altered compared to the wild-type cell. In some cases, the lipid pathway enzyme comprises an enzyme that modifies a fatty acid. In some cases, the lipid pathway enzyme is selected from a stearoyl-ACP desaturase and a glycerolipid desaturase. In some cases, the cell has been genetically engineered and/or selected to express a lower level of a lipid pathway enzyme, or not to express a specific lipid pathway enzyme at all (i.e., wherein a lipid pathway enzyme has been knockout, or replaced with an exogenous gene).

Some microalgae produce significant quantities of non-lipid metabolites, such as, for example, polysaccharides. Because polysaccharide biosynthesis can use a significant proportion of the total metabolic energy available to cells, mutagenesis of lipid-producing cells followed by screening for reduced or eliminated polysaccharide production generates novel strains that are capable of producing higher yields of lipids.

In other embodiments, the present invention is directed to an oil-producing microbe containing one or more exogenous genes, wherein the exogenous genes encode protein(s) selected from the group consisting of a fatty acyl-ACP thioesterase, a fatty acyl-CoA reductase, a fatty aldehyde reductase, a fatty acyl-CoA/aldehyde reductase, a fatty aldehyde decarbonylase, a desaturase, and an acyl carrier protein. In another embodiment, an endogenous desaturase gene is overexpressed in a micro containing one or more of the above exogenous genes. In one embodiment, the exogenous gene is in operable linkage with a promoter, which is inducible or repressible in response to a stimulus. In some cases, the stimulus is selected from the group consisting of an exogenously provided small molecule, heat, cold, and limited or no nitrogen in the culture media. In some cases, the exogenous gene is expressed in a cellular compartment. In some embodiments, the cellular compartment is selected from the group consisting of a chloroplast, a plastid and a mitochondrion. In some embodiments the microbe is *Prototheca moriformis, Prototheca krugani, Prototheca stagnora* or *Prototheca zopfii*.

In one embodiment, the exogenous gene encodes a fatty acid acyl-ACP thioesterase. In some cases, the thioesterase encoded by the exogenous gene catalyzes the cleavage of an 8 to 18-carbon fatty acid from an acyl carrier protein (ACP). In some cases, the thioesterase encoded by the exogenous gene catalyzes the cleavage of a 10 to 14-carbon fatty acid from an ACP. In one embodiment, the thioesterase encoded by the exogenous gene catalyzes the cleavage of a 12-carbon fatty acid from an ACP.

In one embodiment, the exogenous gene encodes a fatty acyl-CoA/aldehyde reductase. In some cases, the reductase encoded by the exogenous gene catalyzes the reduction of an 8 to 18-carbon fatty acyl-CoA to a corresponding primary alcohol. In some cases, the reductase encoded by the exogenous gene catalyzes the reduction of a 10 to 14-carbon fatty acyl-CoA to a corresponding primary alcohol. In one embodiment, the reductase encoded by the exogenous gene catalyzes the reduction of a 12-carbon fatty acyl-CoA to dodecanol.

The present invention also provides a recombinant *Prototheca* cell containing two exogenous genes, wherein a first exogenous gene encodes a fatty acyl-ACP thioesterase and a second exogenous gene encodes a protein selected from the group consisting of a fatty acyl-CoA reductase, a fatty acyl-CoA/aldehyde reductase, and an acyl carrier protein. In some cases, the two exogenous genes are each in operable linkage with a promoter, which is inducible in response to a stimulus. In some cases, each promoter is inducible in response to an identical stimulus, such as limited or no nitrogen in the culture media. Limitation or complete lack of nitrogen in the culture media stimulates oil production in some microorganisms such as *Prototheca* species, and can be used as a trigger to induce oil production to high levels. When used in combination with the genetic engineering methods disclosed herein, the lipid as a percentage of dry cell weight can be pushed to high levels such as at least 30%, at least 40%, at least 50%, at least 60%, at least 70% and at least 75%; methods disclosed herein provide for cells with these levels of lipid, wherein the lipid is at least 1%-5%, preferably at least 4%, C8-C14, at least 0.25%-1%, preferably at least 0.3%, C8, at least 1%-5%, preferably at least 2%, C10, at least 1%-5%, preferably at least 2%, C12, and at least 1%-5%, preferably at least 2%, C14. In some embodiments the cells are over 10%, over 15%, over 20%, or over 25% lipid by dry cell weight and contain lipid that is at least 5%, at least 10% or at least 15% C8-C14, at least 10%, at least 15%, at least 20%, at least 25% or at least 30% C8-C14, at least 20%, at least 25%, at least 30%, at least 35% or at least 40%, C8-C14, 5%-40%, preferably 10-30%, C8-C14 and 10%-40%, preferably 20-30%, C8-C14.

The novel oils disclosed herein are distinct from other naturally occurring oils that are high in mid-chain fatty acids, such as palm oil, palm kernel oil, and coconut oil. For example, levels of contaminants such as carotenoids are far higher in palm oil and palm kernel oil than in the oils of the invention. Palm and palm kernel oils in particular contain alpha and beta carotenes and lycopene in much higher amounts than is in the oils of the invention. In addition, over 20 different carotenoids are found in palm and palm kernel oil, whereas the Examples demonstrate that the oils of the invention contain very few carotenoids species and very low levels. In addition, the levels of vitamin E compounds such as tocotrienols are far higher in palm, palm kernel, and coconut oil than in the oils of the invention.

In one embodiment, the thioesterase encoded by the first exogenous gene catalyzes the cleavage of an 8 to 18-carbon fatty acid from an ACP. In some embodiments, the second exogenous gene encodes a fatty acyl-CoA/aldehyde reductase which catalyzes the reduction of an 8 to 18-carbon fatty acyl-CoA to a corresponding primary alcohol. In some cases, the thioesterase encoded by the first exogenous gene catalyzes the cleavage of a 10 to 14-carbon fatty acid from an ACP, and the reductase encoded by the second exogenous gene catalyzes the reduction of a 10 to 14-carbon fatty acyl-CoA to the corresponding primary alcohol, wherein the thioesterase and the reductase act on the same carbon chain length. In one embodiment, the thioesterase encoded by the first exogenous gene catalyzes the cleavage of a 12-carbon fatty acid from an ACP, and the reductase encoded by the second exogenous gene catalyzes the reduction of a 12-carbon fatty acyl-CoA to dodecanol. In some embodiments, the second exogenous gene encodes a fatty acyl-CoA reductase which catalyzes the reduction of an 8 to 18-carbon fatty acyl-CoA to a corresponding aldehyde. In some embodiments, the second exogenous gene encodes an acyl carrier protein that is naturally co-expressed with the fatty acyl-ACP thioesterase.

In some embodiments, the second exogenous gene encodes a fatty acyl-CoA reductase, and the microbe further contains a third exogenous gene encoding a fatty aldehyde decarbonylase. In some cases, the thioesterase encoded by the first exogenous gene catalyzes the cleavage of an 8 to 18-carbon fatty acid from an ACP, the reductase encoded by the second exogenous gene catalyzes the reduction of an 8 to 18-carbon fatty acyl-CoA to a corresponding fatty aldehyde, and the decarbonylase encoded by the third exogenous gene catalyzes the conversion of an 8 to 18-carbon fatty aldehyde to a corresponding alkane, wherein the thioesterase, the reductase, and the decarbonylase act on the same carbon chain length.

In some embodiments, the second exogenous gene encodes an acyl carrier protein, and the microbe further contains a third exogenous gene encoding a protein selected from the group consisting of a fatty acyl-CoA reductase and a fatty acyl-CoA/aldehyde reductase. In some cases, the third exogenous gene encodes a fatty acyl-CoA reductase, and the microbe further contains a fourth exogenous gene encoding a fatty aldehyde decarbonylase.

The present invention also provides methods for producing an alcohol comprising culturing a population of recombinant microorganisms (e.g., *Prototheca* cells) in a culture medium, wherein the cells contain (i) a first exogenous gene encoding a fatty acyl-ACP thioesterase, and (ii) a second exogenous gene encoding a fatty acyl-CoA/aldehyde reductase, and the cells synthesize a fatty acid linked to an acyl carrier protein (ACP), the fatty acyl-ACP thioesterase catalyzes the cleavage of the fatty acid from the ACP to yield, through further processing, a fatty acyl-CoA, and the fatty acyl-CoA/aldehyde reductase catalyzes the reduction of the acyl-CoA to an alcohol.

The present invention also provides methods of producing a lipid molecule in a microorganism (e.g., a *Prototheca* cell). In one embodiment, the method comprises culturing a population of *Prototheca* cells in a culture medium, wherein the cells contain (i) a first exogenous gene encoding a fatty acyl-ACP thioesterase, and (ii) a second exogenous gene encoding a fatty acyl-CoA reductase, and wherein the microbes synthesize a fatty acid linked to an acyl carrier protein (ACP), the fatty acyl-ACP thioesterase catalyzes the cleavage of the fatty acid from the ACP to yield, through further processing, a fatty acyl-CoA, and the fatty acyl-CoA reductase catalyzes the reduction of the acyl-CoA to an aldehyde.

The present invention also provides methods of producing a fatty acid molecule having a specified carbon chain length in a microorganism (e.g., a *Prototheca* cell). In one embodiment, the method comprises culturing a population of lipid-producing *Prototheca* cells in a culture medium, wherein the microbes contain an exogenous gene encoding a fatty acyl-ACP thioesterase having an activity specific or preferential to a certain carbon chain length, such as 8, 10, 12 or 14 carbon atoms, and wherein the microbes synthesize a fatty acid linked to an acyl carrier protein (ACP) and the thioesterase catalyzes the cleavage of the fatty acid from the ACP when the fatty acid has been synthesized to the specific carbon chain length.

In the various embodiments described above, the microorganism (e.g., a *Prototheca* cell) can contain at least one exogenous gene encoding a lipid pathway enzyme. In some cases, the lipid pathway enzyme is selected from the group consisting of a stearoyl-ACP desaturase, a glycerolipid desaturase, a pyruvate dehydrogenase, an acetyl-CoA carboxylase, an acyl carrier protein, and a glycerol-3 phosphate acyltransferase. In other cases, the microorganism (e.g., *Prototheca* cell) contains a lipid modification enzyme selected from the group consisting of a fatty acyl-ACP thioesterase, a fatty acyl-CoA/aldehyde reductase, a fatty acyl-CoA reductase, a fatty aldehyde reductase, a fatty aldehyde decarbonylase, and/or an acyl carrier protein.

A number of exemplary transformation cassettes or constructs used to express a variety of the lipid pathway enzymes and lipid modification enzymes discussed herein are presented in the Examples. Other useful constructs, without limitation, are listed in Table 8A, below.

TABLE 8A

Exemplary transformation constructs, codon-optimized coding regions, and enzymes.

| Transformation Construct/Coding region/Enzyme | SEQ ID NO |
|---|---|
| *C. hookeriana* C10:0 specific thioesterase construct | 243 |
| coding region for *C. hookeriana* C10:0 specific thioesterase (codon-optimized) | 244 |
| *C. hookeriana* KAS IV enzyme construct | 245 |
| coding region for *C. hookeriana* KAS IV enzyme (codon-optimized) | 246 |
| *C. hookeriana* KAS IV enzyme | 247 |
| *C. hookeriana* C10:0 specific thioesterase plus *C. hookeriana* KAS IV enzyme construct | 248 |
| coding region for *C. lanceolata* C10:0 specific thioesterase with UTEX 1435 Δ12 fatty acid desaturase | 249 |
| *U. californica* C12:0 specific thioesterase construct | 250 |
| coding region for *U. californica* C12:0 specific thioesterase (codon-optimized) | 251 |
| *G. mangostana* C16:0 thioesterase construct | 252 |
| coding region for *G. mangostana* C16:0 thioesterase (codon-optimized) | 253 |
| *B. napus* C18:0 thioesterase construct | 254 |
| coding region for *B. napus* C18:0 thioesterase (codon-optimized) | 255 |
| *O. europaea* stearoyl-ACP desaturase construct | 256 |
| coding region for *O. europaea* stearoyl-ACP desaturase (codon-optimized) | 257 |
| *C. hookeriana* C16:0 thioesterase construct | 258 |
| coding region for *C. hookeriana* C16:0 thioesterase (codon-optimized) | 259 |
| *E. guineensis* C16:0 thioesterase construct | 260 |
| coding region for *E. guineensis* C16:0 thioesterase (codon-optimized) | 261 |
| *C. tinctorius* ACP-thioesterase at Δ12 fatty acid desaturase locus construct | 262 |
| coding region for *C. tinctorius* ACP-thioesterase (codon-optimized) | 263 |
| *M. fragrans* C14:0-C18:0 broad specificity thioesterase construct | 264 |
| coding region for *M. fragrans* C14:0-C18:0 broad specificity thioesterase (codon-optimized) | 265 |
| coding region for *M. fragrans* C:14:0 specific thioesterase | 266 |
| *M. fragrans* C14:0 specfic thioesterase with Δ12 FAD transit peptide | 267 |
| *Ricinus communis* ACP-thioesterase construct | 268 |
| coding region for *Ricinus communis* ACP-thioesterase (codon-optimized) | 269 |
| *C. camphora* C14:0 thioesterase construct | 270 |
| coding region for *C. camphora* C14:0 thioesterase (codon-optimized) | 271 |
| *C. camphora* C14:0 specific thioesterase construct | 272 |

TABLE 8A-continued

Exemplary transformation constructs, codon-optimized coding regions, and enzymes.

| Transformation Construct/Coding region/Enzyme | SEQ ID NO |
|---|---|
| *C. camphora* C14:0 specific thioesterase construct | 273 |
| *U. Americana* C10:0-C16:0 specific thioesterase in a SAD locus | 274 |
| coding region for *U. Americana* C10:0-C16:0 specific thioesterase (codon-optimized) | 275 |
| *C. wrightii* KASA1 + *C. wrightii* FatB2 thioesterase + suc2 construct | 276 |
| coding region for *C. wrightii* KASA1 (codon-optimized) | 277 |
| coding region for *C. wrightii* FatB2 thioesterase (codon-optimized) | 278 |

VI. Fuels and Chemicals Production

For the production of fuel in accordance with the methods of the invention lipids produced by cells of the invention are harvested, or otherwise collected, by any convenient means. Lipids can be isolated by whole cell extraction. The cells are first disrupted, and then intracellular and cell membrane/cell wall-associated lipids as well as extracellular hydrocarbons can be separated from the cell mass, such as by use of centrifugation as described above. Intracellular lipids produced in microorganisms are, in some embodiments, extracted after lysing the cells of the microorganism. Once extracted, the lipids are further refined to produce oils, fuels, or oleochemicals.

After completion of culturing, the microorganisms can be separated from the fermentation broth. Optionally, the separation is effected by centrifugation to generate a concentrated paste. Centrifugation does not remove significant amounts of intracellular water from the microorganisms and is not a drying step. The biomass can then optionally be washed with a washing solution (e.g., DI water) to get rid of the fermentation broth and debris. Optionally, the washed microbial biomass may also be dried (oven dried, lyophilized, etc.) prior to cell disruption. Alternatively, cells can be lysed without separation from some or all of the fermentation broth when the fermentation is complete. For example, the cells can be at a ratio of less than 1:1 v:v cells to extracellular liquid when the cells are lysed.

Microorganisms containing a lipid can be lysed to produce a lysate. As detailed herein, the step of lysing a microorganism (also referred to as cell lysis) can be achieved by any convenient means, including heat-induced lysis, adding a base, adding an acid, using enzymes such as proteases and polysaccharide degradation enzymes such as amylases, using ultrasound, mechanical lysis, using osmotic shock, infection with a lytic virus, and/or expression of one or more lytic genes. Lysis is performed to release intracellular molecules which have been produced by the microorganism. Each of these methods for lysing a microorganism can be used as a single method or in combination simultaneously or sequentially. The extent of cell disruption can be observed by microscopic analysis. Using one or more of the methods described herein, typically more than 70% cell breakage is observed. Preferably, cell breakage is more than 80%, more preferably more than 90% and most preferred about 100%.

In particular embodiments, the microorganism is lysed after growth, for example to increase the exposure of cellular lipid and/or hydrocarbon for extraction or further processing. The timing of lipase expression (e.g., via an inducible promoter) or cell lysis can be adjusted to optimize the yield of lipids and/or hydrocarbons. Below are described a number of lysis techniques. These techniques can be used individually or in combination.

In one embodiment of the present invention, the step of lysing a microorganism comprises heating of a cellular suspension containing the microorganism. In this embodiment, the fermentation broth containing the microorganisms (or a suspension of microorganisms isolated from the fermentation broth) is heated until the microorganisms, i.e., the cell walls and membranes of microorganisms degrade or breakdown. Typically, temperatures applied are at least 50° C. Higher temperatures, such as, at least 30° C. at least 60° C., at least 70° C., at least 80° C., at least 90° C., at least 100° C., at least 110° C., at least 120° C., at least 130° C. or higher are used for more efficient cell lysis. Lysing cells by heat treatment can be performed by boiling the microorganism. Alternatively, heat treatment (without boiling) can be performed in an autoclave. The heat treated lysate may be cooled for further treatment. Cell disruption can also be performed by steam treatment, i.e., through addition of pressurized steam. Steam treatment of microalgae for cell disruption is described, for example, in U.S. Pat. No. 6,750,048. In some embodiments, steam treatment may be achieved by sparging steam into the fermentor and maintaining the broth at a desired temperature for less than about 90 minutes, preferably less than about 60 minutes, and more preferably less than about 30 minutes.

In another embodiment of the present invention, the step of lysing a microorganism comprises adding a base to a cellular suspension containing the microorganism. The base should be strong enough to hydrolyze at least a portion of the proteinaceous compounds of the microorganisms used. Bases which are useful for solubilizing proteins are known in the art of chemistry. Exemplary bases which are useful in the methods of the present invention include, but are not limited to, hydroxides, carbonates and bicarbonates of lithium, sodium, potassium, calcium, and mixtures thereof. A preferred base is KOH. Base treatment of microalgae for cell disruption is described, for example, in U.S. Pat. No. 6,750,048.

In another embodiment of the present invention, the step of lysing a microorganism comprises adding an acid to a cellular suspension containing the microorganism. Acid lysis can be effected using an acid at a concentration of 10-500 mN or preferably 40-160 nM. Acid lysis is preferably performed at above room temperature (e.g., at 40-160°, and preferably a temperature of 50-130°. For moderate temperatures (e.g., room temperature to 100° C. and particularly room temperature to 65°, acid treatment can usefully be combined with sonication or other cell disruption methods.

In another embodiment of the present invention, the step of lysing a microorganism comprises lysing the microorganism by using an enzyme. Preferred enzymes for lysing a microorganism are proteases and polysaccharide-degrading enzymes such as hemicellulase (e.g., hemicellulase from *Aspergillus niger*; Sigma Aldrich, St. Louis, Mo.; #H2125), pectinase (e.g., pectinase from *Rhizopus* sp.; Sigma Aldrich, St. Louis, Mo.; #P2401), Mannaway 4.0 L (Novozymes), cellulase (e.g., cellulose from *Trichoderma viride*; Sigma Aldrich, St. Louis, Mo.; #C9422), and driselase (e.g., driselase from *Basidiomycetes* sp.; Sigma Aldrich, St. Louis, Mo.; #D9515).

In other embodiments of the present invention, lysis is accomplished using an enzyme such as, for example, a cellulase such as a polysaccharide-degrading enzyme, optionally from *Chlorella* or a *Chlorella* virus, or a proteases, such as *Streptomyces griseus* protease, chymotrypsin, proteinase K, proteases listed in Degradation of Polylactide by Commercial Proteases, Oda Y et al., Journal of Polymers and the Environment, Volume 8, Number 1, January 2000, pp. 29-32 (4), Alcalase 2.4 FG (Novozymes), and Flavourzyme 100 L (Novozymes). Any combination of a protease and a polysaccharide-degrading enzyme can also be used, including any combination of the preceding proteases and polysaccharide-degrading enzymes.

In another embodiment, lysis can be performed using an expeller press. In this process, biomass is forced through a screw-type device at high pressure, lysing the cells and causing the intracellular lipid to be released and separated from the protein and fiber (and other components) in the cell.

In another embodiment of the present invention, the step of lysing a microorganism is performed by using ultrasound, i.e., sonication. Thus, cells can also by lysed with high frequency sound. The sound can be produced electronically and transported through a metallic tip to an appropriately concentrated cellular suspension. This sonication (or ultrasonication) disrupts cellular integrity based on the creation of cavities in cell suspension.

In another embodiment of the present invention, the step of lysing a microorganism is performed by mechanical lysis. Cells can be lysed mechanically and optionally homogenized to facilitate hydrocarbon (e.g., lipid) collection. For example, a pressure disrupter can be used to pump a cell containing slurry through a restricted orifice valve. High pressure (up to 1500 bar) is applied, followed by an instant expansion through an exiting nozzle. Cell disruption is accomplished by three different mechanisms: impingement on the valve, high liquid shear in the orifice, and sudden pressure drop upon discharge, causing an explosion of the cell. The method releases intracellular molecules. Alternatively, a ball mill can be used. In a ball mill, cells are agitated in suspension with small abrasive particles, such as beads. Cells break because of shear forces, grinding between beads, and collisions with beads. The beads disrupt the cells to release cellular contents. Cells can also be disrupted by shear forces, such as with the use of blending (such as with a high speed or Waring blender as examples), the french press, or even centrifugation in case of weak cell walls, to disrupt cells.

In another embodiment of the present invention, the step of lysing a microorganism is performed by applying an osmotic shock.

In another embodiment of the present invention, the step of lysing a microorganism comprises infection of the microorganism with a lytic virus. A wide variety of viruses are known to lyse microorganisms suitable for use in the present invention, and the selection and use of a particular lytic virus for a particular microorganism is within the level of skill in the art. For example, paramecium bursaria *chlorella* virus (PBCV-1) is the prototype of a group (family Phycodnaviridae, genus *Chlorovirus*) of large, icosahedral, plaque-forming, double-stranded DNA viruses that replicate in, and lyse, certain unicellular, eukaryotic *chlorella*-like green algae. Accordingly, any susceptible microalgae can be lysed by infecting the culture with a suitable *chlorella* virus. Methods of infecting species of *Chlorella* with a *chlorella* virus are known. See for example *Adv. Virus Res.* 2006; 66:293-336; *Virology,* 1999 Apr. 25; 257(1):15-23; *Virology,* 2004 Jan. 5; 318(1):214-23; *Nucleic Acids Symp. Ser.* 2000; (44):161-2; *J. Virol.* 2006 March; 80(5):2437-44; and *Annu. Rev. Microbiol.* 1999; 53:447-94.

In another embodiment of the present invention, the step of lysing a microorganism comprises autolysis. In this embodiment, a microorganism according to the invention is genetically engineered to produce a lytic protein that will lyse the microorganism. This lytic gene can be expressed using an inducible promoter so that the cells can first be grown to a desirable density in a fermentor, followed by induction of the promoter to express the lytic gene to lyse the cells. In one embodiment, the lytic gene encodes a polysaccharide-degrading enzyme. In certain other embodiments, the lytic gene is a gene from a lytic virus. Thus, for example, a lytic gene from a *Chlorella* virus can be expressed in an algal cell; see *Virology* 260, 308-315 (1999); *FEMS Microbiology Letters* 180 (1999) 45-53; *Virology* 263, 376-387 (1999); and *Virology* 230, 361-368 (1997). Expression of lytic genes is preferably done using an inducible promoter, such as a promoter active in microalgae that is induced by a stimulus such as the presence of a small molecule, light, heat, and other stimuli.

Various methods are available for separating lipids from cellular lysates produced by the above methods. For example, lipids and lipid derivatives such as fatty aldehydes, fatty alcohols, and hydrocarbons such as alkanes can be extracted with a hydrophobic solvent such as hexane (see Frenz et al. 1989, Enzyme Microb. Technol., 11:717). Lipids and lipid derivatives can also be extracted using liquefaction (see for example Sawayama et al. 1999, Biomass and Bioenergy 17:33-39 and Inoue et al. 1993, Biomass Bioenergy 6(4):269-274); oil liquefaction (see for example Minowa et al. 1995, Fuel 74(12): 1735-1738); and supercritical $CO_2$ extraction (see for example Mendes et al. 2003, Inorganica Chimica Acta 356: 328-334). Miao and Wu describe a protocol of the recovery of microalgal lipid from a culture of *Chlorella prototheocoides* in which the cells were harvested by centrifugation, washed with distilled water and dried by freeze drying. The resulting cell powder was pulverized in a mortar and then extracted with n-hexane. Miao and Wu, Biosource Technology (2006) 97:841-846.

Thus, lipids, lipid derivatives and hydrocarbons generated by the microorganisms of the present invention can be recovered by extraction with an organic solvent. In some cases, the preferred organic solvent is hexane. Typically, the organic solvent is added directly to the lysate without prior separation of the lysate components. In one embodiment, the lysate generated by one or more of the methods described above is contacted with an organic solvent for a period of time sufficient to allow the lipid and/or hydrocarbon components to form a solution with the organic solvent. In some cases, the solution can then be further refined to recover specific desired lipid or hydrocarbon components. Hexane extraction methods are well known in the art.

Lipids and lipid derivatives such as fatty aldehydes, fatty alcohols, and hydrocarbons such as alkanes produced by cells as described herein can be modified by the use of one or more enzymes, including a lipase, as described above. When the hydrocarbons are in the extracellular environment of the cells, the one or more enzymes can be added to that environment under conditions in which the enzyme modifies the hydrocarbon or completes its synthesis from a hydrocarbon precursor. Alternatively, the hydrocarbons can be partially, or completely, isolated from the cellular material before addition of one or more catalysts such as enzymes. Such catalysts are exogenously added, and their activity occurs outside the cell or in vitro.

Thus, lipids and hydrocarbons produced by cells in vivo, or enzymatically modified in vitro, as described herein can be optionally further processed by conventional means. The processing can include "cracking" to reduce the size, and thus increase the hydrogen:carbon ratio, of hydrocarbon molecules. Catalytic and thermal cracking methods are routinely used in hydrocarbon and triglyceride oil processing. Catalytic methods involve the use of a catalyst, such as a solid acid catalyst. The catalyst can be silica-alumina or a zeolite, which result in the heterolytic, or asymmetric, breakage of a carbon-carbon bond to result in a carbocation and a hydride anion. These reactive intermediates then undergo either rearrangement or hydride transfer with another hydrocarbon. The reactions can thus regenerate the intermediates to result in a self-propagating chain mechanism. Hydrocarbons can also be processed to reduce, optionally to zero, the number of carbon-carbon double, or triple, bonds therein. Hydrocarbons can also be processed to remove or eliminate a ring or cyclic structure therein. Hydrocarbons can also be processed to increase the hydrogen:carbon ratio. This can include the addition of hydrogen ("hydrogenation") and/or the "cracking" of hydrocarbons into smaller hydrocarbons.

Thermal methods involve the use of elevated temperature and pressure to reduce hydrocarbon size. An elevated temperature of about 800° C. and pressure of about 700 kPa can be used. These conditions generate "light," a term that is sometimes used to refer to hydrogen-rich hydrocarbon molecules (as distinguished from photon flux), while also generating, by condensation, heavier hydrocarbon molecules which are relatively depleted of hydrogen. The methodology provides homolytic, or symmetrical, breakage and produces alkenes, which may be optionally enzymatically saturated as described above.

Catalytic and thermal methods are standard in plants for hydrocarbon processing and oil refining. Thus hydrocarbons produced by cells as described herein can be collected and processed or refined via conventional means. See Hillen et al. (Biotechnology and Bioengineering, Vol. XXIV:193-205 (1982)) for a report on hydrocracking of microalgae-produced hydrocarbons. In alternative embodiments, the fraction is treated with another catalyst, such as an organic compound, heat, and/or an inorganic compound. For processing of lipids into biodiesel, a transesterification process is used as described below in this Section.

Hydrocarbons produced via methods of the present invention are useful in a variety of industrial applications. For example, the production of linear alkylbenzene sulfonate (LAS), an anionic surfactant used in nearly all types of detergents and cleaning preparations, utilizes hydrocarbons generally comprising a chain of 10-14 carbon atoms. See, for example, U.S. Pat. Nos. 6,946,430; 5,506,201; 6,692,730; 6,268,517; 6,020,509; 6,140,302; 5,080,848; and 5,567,359. Surfactants, such as LAS, can be used in the manufacture of personal care compositions and detergents, such as those described in U.S. Pat. Nos. 5,942,479; 6,086,903; 5,833,999; 6,468,955; and 6,407,044.

Increasing interest is directed to the use of hydrocarbon components of biological origin in fuels, such as biodiesel, renewable diesel, and jet fuel, since renewable biological starting materials that may replace starting materials derived from fossil fuels are available, and the use thereof is desirable. There is an urgent need for methods for producing hydrocarbon components from biological materials. The present invention fulfills this need by providing methods for production of biodiesel, renewable diesel, and jet fuel using the lipids generated by the methods described herein as a biological material to produce biodiesel, renewable diesel, and jet fuel.

Traditional diesel fuels are petroleum distillates rich in paraffinic hydrocarbons. They have boiling ranges as broad as 370° to 780° F., which are suitable for combustion in a compression ignition engine, such as a diesel engine vehicle. The American Society of Testing and Materials (ASTM) establishes the grade of diesel according to the boiling range, along with allowable ranges of other fuel properties, such as cetane number, cloud point, flash point, viscosity, aniline point, sulfur content, water content, ash content, copper strip corrosion, and carbon residue. Technically, any hydrocarbon distillate material derived from biomass or otherwise that meets the appropriate ASTM specification can be defined as diesel fuel (ASTM D975), jet fuel (ASTM D1655), or as biodiesel if it is a fatty acid methyl ester (ASTM D6751).

After extraction, lipid and/or hydrocarbon components recovered from the microbial biomass described herein can be subjected to chemical treatment to manufacture a fuel for use in diesel vehicles and jet engines.

Biodiesel is a liquid which varies in color—between golden and dark brown—depending on the production feedstock. It is practically immiscible with water, has a high boiling point and low vapor pressure. Biodiesel refers to a diesel-equivalent processed fuel for use in diesel-engine vehicles. Biodiesel is biodegradable and non-toxic. An additional benefit of biodiesel over conventional diesel fuel is lower engine wear. Typically, biodiesel comprises C14-C18 alkyl esters. Various processes convert biomass or a lipid produced and isolated as described herein to diesel fuels. A preferred method to produce biodiesel is by transesterification of a lipid as described herein. A preferred alkyl ester for use as biodiesel is a methyl ester or ethyl ester.

Biodiesel produced by a method described herein can be used alone or blended with conventional diesel fuel at any concentration in most modern diesel-engine vehicles. When blended with conventional diesel fuel (petroleum diesel), biodiesel may be present from about 0.1% to about 99.9%. Much of the world uses a system known as the "B" factor to state the amount of biodiesel in any fuel mix. For example, fuel containing 20% biodiesel is labeled B20. Pure biodiesel is referred to as B 100.

Biodiesel can also be used as a heating fuel in domestic and commercial boilers. Existing oil boilers may contain rubber parts and may require conversion to run on biodiesel. The conversion process is usually relatively simple, involving the exchange of rubber parts for synthetic parts due to biodiesel being a strong solvent. Due to its strong solvent power, burning biodiesel will increase the efficiency of boilers. Biodiesel can be used as an additive in formulations of diesel to increase the lubricity of pure Ultra-Low Sulfur Diesel (ULSD) fuel, which is advantageous because it has virtually no sulfur content. Biodiesel is a better solvent than petrodiesel and can be used to break down deposits of residues in the fuel lines of vehicles that have previously been run on petrodiesel.

Biodiesel can be produced by transesterification of triglycerides contained in oil-rich biomass. Thus, in another aspect of the present invention a method for producing biodiesel is provided. In a preferred embodiment, the method for producing biodiesel comprises the steps of (a) cultivating a lipid-containing microorganism using methods disclosed herein (b) lysing a lipid-containing microorganism to produce a lysate, (c) isolating lipid from the lysed microorganism, and (d) transesterifying the lipid composition, whereby biodiesel is produced. Methods for growth of a microorganism, lysing a microorganism to produce a lysate, treating the lysate in a medium comprising an organic solvent to form a heterogeneous mixture and separating the treated lysate into a lipid composition have been described above and can also be used in the method of producing biodiesel.

The lipid profile of the biodiesel is usually highly similar to the lipid profile of the feedstock oil. Other oils provided by the methods and compositions of the invention can be subjected to transesterification to yield biodiesel with lipid profiles including (a) at least 1%-5%, preferably at least 4%, C8-C14; (b) at least 0.25%-1%, preferably at least 0.3%, C8; (c) at least 1%-5%, preferably at least 2%, C10; (d) at least 1%-5%, preferably at least 2%, C12; and (3) at least 20%-40%, preferably at least 30%, C8-C14.

Lipid compositions can be subjected to transesterification to yield long-chain fatty acid esters useful as biodiesel. Preferred transesterification reactions are outlined below and include base catalyzed transesterification and transesterification using recombinant lipases. In a base-catalyzed transesterification process, the triacylglycerides are reacted with an alcohol, such as methanol or ethanol, in the presence of an alkaline catalyst, typically potassium hydroxide. This reaction forms methyl or ethyl esters and glycerin (glycerol) as a byproduct.

Animal and plant oils are typically made of triglycerides which are esters of free fatty acids with the trihydric alcohol, glycerol. In transesterification, the glycerol in a triacylglyceride (TAG) is replaced with a short-chain alcohol such as methanol or ethanol. A typical reaction scheme is as follows:

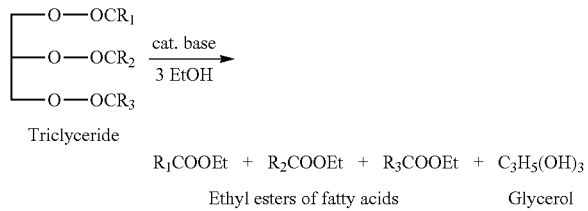

$R_1COOEt + R_2COOEt + R_3COOEt + C_3H_5(OH)_3$

Ethyl esters of fatty acids          Glycerol

In this reaction, the alcohol is deprotonated with a base to make it a stronger nucleophile. Commonly, ethanol or methanol is used in vast excess (up to 50-fold). Normally, this reaction will proceed either exceedingly slowly or not at all. Heat, as well as an acid or base can be used to help the reaction proceed more quickly. The acid or base are not consumed by the transesterification reaction, thus they are not reactants but catalysts. Almost all biodiesel has been produced using the base-catalyzed technique as it requires only low temperatures and pressures and produces over 98% conversion yield (provided the starting oil is low in moisture and free fatty acids).

Transesterification has also been carried out, as discussed above, using an enzyme, such as a lipase instead of a base. Lipase-catalyzed transesterification can be carried out, for example, at a temperature between the room temperature and 80° C., and a mole ratio of the TAG to the lower alcohol of greater than 1:1, preferably about 3:1. Lipases suitable for use in transesterification include, but are not limited to, those listed in Table 9. Other examples of lipases useful for transesterification are found in, e.g. U.S. Pat. Nos. 4,798,793; 4,940,845 5,156,963; 5,342,768; 5,776,741 and WO89/01032. Such lipases include, but are not limited to, lipases produced by microorganisms of *Rhizopus, Aspergillus, Candida, Mucor, Pseudomonas, Rhizomucor, Candida,* and *Humicola* and pancreas lipase.

TABLE 9

Lipases suitable for use in transesterification.

*Aspergillus niger* lipase ABG73614, *Candida antarctica* lipase B (novozym-435) CAA83122, *Candida cylindracea* lipase AAR24090, *Candida lipolytica* lipase (Lipase L; Amano Pharmaceutical Co., Ltd.), *Candida rugosa* lipase (e.g., Lipase-OF; Meito Sangyo Co., Ltd.), *Mucor miehei* lipase (Lipozyme IM 20), *Pseudomonas fluorescens* lipase AAA25882, *Rhizopus japonicas* lipase (Lilipase A-10FG) Q7M4U7_1, *Rhizomucor miehei* lipase B34959, *Rhizopus oryzae* lipase (Lipase F) AAF32408, *Serratia marcescens* lipase (SM Enzyme) ABI13521, *Thermomyces lanuginosa* lipase CAB58509, Lipase P (Nagase ChemteX Corporation), and Lipase QLM (Meito Sangyo Co., Ltd., Nagoya, Japan)

One challenge to using a lipase for the production of fatty acid esters suitable for biodiesel is that the price of lipase is much higher than the price of sodium hydroxide (NaOH) used by the strong base process. This challenge has been addressed by using an immobilized lipase, which can be recycled. However, the activity of the immobilized lipase must be maintained after being recycled for a minimum number of cycles to allow a lipase-based process to compete with the strong base process in terms of the production cost. Immobilized lipases are subject to poisoning by the lower alcohols typically used in transesterification. U.S. Pat. No. 6,398,707 (issued Jun. 4, 2002 to Wu et al.) describes methods for enhancing the activity of immobilized lipases and regenerating immobilized lipases having reduced activity. Some suitable methods include immersing an immobilized lipase in an alcohol having a carbon atom number not less than 3 for a period of time, preferably from 0.5-48 hours, and more preferably from 0.5-1.5 hours. Some suitable methods also include washing a deactivated immobilized lipase with an alcohol having a carbon atom number not less than 3 and then immersing the deactivated immobilized lipase in a vegetable oil for 0.5-48 hours.

In particular embodiments, a recombinant lipase is expressed in the same microorganisms that produce the lipid on which the lipase acts. Suitable recombinant lipases include those listed above in Table 9 and/or having GenBank Accession numbers listed above in Table 9, or a polypeptide that has at least 70% amino acid identity with one of the lipases listed above in Table 9 and that exhibits lipase activity. In additional embodiments, the enzymatic activity is present in a sequence that has at least about 75%, at least about 80%, at least about 85%, at least about 90%, at least about 95%, or at least about 99% identity with one of the above described sequences, all of which are hereby incorporated by reference as if fully set forth. DNA encoding the lipase and selectable marker is preferably codon-optimized cDNA. Methods of recoding genes for expression in microalgae are described in U.S. Pat. No. 7,135,290.

The common international standard for biodiesel is EN 14214. ASTM D6751 is the most common biodiesel standard referenced in the United States and Canada. Germany uses DIN EN 14214 and the UK requires compliance with BS EN 14214. Basic industrial tests to determine whether the products conform to these standards typically include gas chromatography, HPLC, and others. Biodiesel meeting the quality standards is very non-toxic, with a toxicity rating ($LD_{50}$) of greater than 50 mL/kg.

Although biodiesel that meets the ASTM standards has to be non-toxic, there can be contaminants which tend to crystallize and/or precipitate and fall out of solution as sediment. Sediment formation is particularly a problem when biodiesel is used at lower temperatures. The sediment or precipitates may cause problems such as decreasing fuel flow, clogging fuel lines, clogging filters, etc. Processes are well-known in the art that specifically deal with the removal of these contaminants and sediments in biodiesel in order to produce a higher quality product. Examples for such processes include, but are not limited to, pretreatment of the oil to remove contaiminants such as phospholipids and free fatty acids (e.g., degumming, caustic refining and silica adsorbant filtration) and cold filtration. Cold filtration is a process that was developed specifically to remove any particulates and sediments that are present in the biodiesel after production. This process cools the biodiesel and filters out any sediments or precipitates that might form when the fuel is used at a lower temperature. Such a process is well known in the art and is described in US Patent Application Publication No. 2007-0175091. Suitable methods may include cooling the biodiesel to a temperature of less than about 38° C. so that the impurities and contaminants precipitate out as particulates in the biodiesel liquid. Diatomaceous earth or other filtering material may then added to the cooled biodiesel to form a slurry, which may then filtered through a pressure leaf or other type of filter to remove the particulates. The filtered biodiesel may then be run through a polish filter to remove any remaining sediments and diatomaceous earth, so as to produce the final biodiesel product.

Example 13 describes the production of biodiesel using triglyceride oil from *Prototheca moriformis*. The Cold Soak Filterability by the ASTM D6751 A1 method of the biodiesel produced in Example 13 was 120 seconds for a volume of 300 ml. This test involves filtration of 300 ml of B 100, chilled to 40° F. for 16 hours, allowed to warm to room temp, and filtered under vacuum using 0.7 micron glass fiber filter with stainless steel support. Oils of the invention can be transesterified to generate biodiesel with a cold soak time of less than 120 seconds, less than 100 seconds, and less than 90 seconds.

Subsequent processes may also be used if the biodiesel will be used in particularly cold temperatures. Such processes include winterization and fractionation. Both processes are designed to improve the cold flow and winter performance of the fuel by lowering the cloud point (the temperature at which the biodiesel starts to crystallize). There are several approaches to winterizing biodiesel. One approach is to blend the biodiesel with petroleum diesel. Another approach is to use additives that can lower the cloud point of biodiesel. Another approach is to remove saturated methyl esters indiscriminately by mixing in additives and allowing for the crystallization of saturates and then filtering out the crystals. Fractionation selectively separates methyl esters into individual components or fractions, allowing for the removal or inclusion of specific methyl esters. Fractionation methods include urea fractionation, solvent fractionation and thermal distillation.

Another valuable fuel provided by the methods of the present invention is renewable diesel, which comprises alkanes, such as C10:0, C12:0, C14:0, C16:0 and C18:0 and thus, are distinguishable from biodiesel. High quality renewable diesel conforms to the ASTM D975 standard. The lipids produced by the methods of the present invention can serve as feedstock to produce renewable diesel. Thus, in another aspect of the present invention, a method for producing renewable diesel is provided. Renewable diesel can be produced by at least three processes: hydrothermal processing (hydrotreating); hydroprocessing; and indirect liquefaction. These processes yield non-ester distillates. During these processes, triacylglycerides produced and isolated as described herein, are converted to alkanes.

In one embodiment, the method for producing renewable diesel comprises (a) cultivating a lipid-containing microorganism using methods disclosed herein (b) lysing the microorganism to produce a lysate, (c) isolating lipid from the lysed microorganism, and (d) deoxygenating and hydrotreating the lipid to produce an alkane, whereby renewable diesel is produced. Lipids suitable for manufacturing renewable diesel can be obtained via extraction from microbial biomass using an organic solvent such as hexane, or via other methods, such as those described in U.S. Pat. No. 5,928,696. Some suitable methods may include mechanical pressing and centrifuging.

In some methods, the microbial lipid is first cracked in conjunction with hydrotreating to reduce carbon chain length and saturate double bonds, respectively. The material is then isomerized, also in conjunction with hydrotreating. The naptha fraction can then be removed through distillation, followed by additional distillation to vaporize and distill components desired in the diesel fuel to meet an ASTM D975 standard while leaving components that are heavier than desired for meeting the D975 standard. Hydrotreating, hydrocracking, deoxygenation and isomerization methods of chemically modifying oils, including triglyceride oils, are well known in the art. See for example European patent applications EP1741768 (A1); EP1741767 (A1); EP1682466 (A1); EP1640437 (A1); EP1681337 (A1); EP1795576 (A1); and U.S. Pat. Nos. 7,238,277; 6,630,066; 6,596,155; 6,977,322; 7,041,866; 6,217,746; 5,885,440; 6,881,873.

In one embodiment of the method for producing renewable diesel, treating the lipid to produce an alkane is performed by hydrotreating of the lipid composition. In hydrothermal processing, typically, biomass is reacted in water at an elevated temperature and pressure to form oils and residual solids. Conversion temperatures are typically 300° to 660° F., with pressure sufficient to keep the water primarily as a liquid, 100 to 170 standard atmosphere (atm). Reaction times are on the order of 15 to 30 minutes. After the reaction is completed, the organics are separated from the water. Thereby a distillate suitable for diesel is produced.

In some methods of making renewable diesel, the first step of treating a triglyceride is hydroprocessing to saturate double bonds, followed by deoxygenation at elevated temperature in the presence of hydrogen and a catalyst. In some methods, hydrogenation and deoxygenation occur in the same reaction. In other methods deoxygenation occurs before hydrogenation. Isomerization is then optionally performed, also in the presence of hydrogen and a catalyst. Naphtha components are preferably removed through distillation. For examples, see U.S. Pat. No. 5,475,160 (hydrogenation of triglycerides); U.S. Pat. No. 5,091,116 (deoxygenation, hydrogenation and gas removal); U.S. Pat. No. 6,391,815 (hydrogenation); and U.S. Pat. No. 5,888,947 (isomerization).

One suitable method for the hydrogenation of triglycerides includes preparing an aqueous solution of copper, zinc, magnesium and lanthanum salts and another solution of alkali metal or preferably, ammonium carbonate. The two solutions may be heated to a temperature of about 20° C. to about 85° C. and metered together into a precipitation container at rates such that the pH in the precipitation container is maintained between 5.5 and 7.5 in order to form a catalyst. Additional water may be used either initially in the precipitation container or added concurrently with the salt solution and precipitation solution. The resulting precipitate may then be thoroughly washed, dried, calcined at about 300° C. and activated in hydrogen at temperatures ranging from about 100° C. to about 400° C. One or more triglycerides may then be contacted and reacted with hydrogen in the presence of the above-described catalyst in a reactor. The reactor may be a trickle bed reactor, fixed bed gas-solid reactor, packed bubble column reactor, continuously stirred tank reactor, a slurry phase reactor, or any other suitable reactor type known in the art. The process may be carried out either batchwise or in continuous fashion. Reaction temperatures are typically in the range of from about 170° C to about 250° C while reaction pressures are typically in the range of from about 300 psig to about 2000 psig. Moreover, the molar ratio of hydrogen to triglyceride in the process of the present invention is typically in the range of from about 20:1 to about 700:1. The process is typically carried out at a weight hourly space velocity (WHSV) in the range of from about 0.1 $hr^{-1}$ to about 5 $hr^{-1}$. One skilled in the art will recognize that the time period required for reaction will vary according to the temperature used, the molar ratio of hydrogen to triglyceride, and the partial pressure of hydrogen. The products produced by the such hydrogenation processes include fatty alcohols, glycerol, traces of paraffins and unreacted triglycerides. These products are typically separated by conventional means such as, for example, distillation, extraction, filtration, crystallization, and the like.

Petroleum refiners use hydroprocessing to remove impurities by treating feeds with hydrogen. Hydroprocessing conversion temperatures are typically 300° to 700° F. Pressures are typically 40 to 100 atm. The reaction times are typically on the order of 10 to 60 minutes. Solid catalysts are employed to increase certain reaction rates, improve selectivity for certain products, and optimize hydrogen consumption.

Suitable methods for the deoxygenation of an oil includes heating an oil to a temperature in the range of from about 350° F. to about 550° F. and continuously contacting the heated oil with nitrogen under at least pressure ranging from about atmospeheric to above for at least about 5 minutes.

Suitable methods for isomerization include using alkali isomerization and other oil isomerization known in the art.

Hydrotreating and hydroprocessing ultimately lead to a reduction in the molecular weight of the triglyceride feed. The triglyceride molecule is reduced to four hydrocarbon molecules under hydroprocessing conditions: a propane molecule and three heavier hydrocarbon molecules, typically in the C8 to C18 range.

Thus, in one embodiment, the product of one or more chemical reaction(s) performed on lipid compositions of the invention is an alkane mixture that comprises ASTM D975 renewable diesel. Production of hydrocarbons by microorganisms is reviewed by Metzger et al. Appl Microbiol Biotechnol (2005) 66: 486-496 and A Look Back at the U.S. Department of Energy's Aquatic Species Program: Biodiesel from Algae, NREL/TP-580-24190, John Sheehan, Terri Dunahay, John Benemann and Paul Roessler (1998).

The distillation properties of a diesel fuel is described in terms of T10-T90 (temperature at 10% and 90%, respectively, volume distilled). Renewable diesel was produced from *Prototheca moriformis* triglyceride oil and is described in Example 13. The T10-T90 of the material produced in Example 13 was 57.9° C Methods of hydrotreating, isomerization, and other covalent modification of oils disclosed herein, as well as methods of distillation and fractionation (such as cold filtration) disclosed herein, can be employed to generate renewable diesel compositions with other T10-T90 ranges, such as 20, 25, 30, 35, 40, 45, 50, 60 and 65° C using triglyceride oils produced according to the methods disclosed herein.

The T10 of the material produced in Example 13 was 242.1° C Methods of hydrotreating, isomerization, and other covalent modification of oils disclosed herein, as well as methods of distillation and fractionation (such as cold filtration) disclosed herein, can be employed to generate renewable diesel compositions with other T10 values, such as T10 between 180 and 295, between 190 and 270, between 210 and 250, between 225 and 245, and at least 290.

The T90 of the material produced in Example 13 was 300° C Methods of hydrotreating, isomerization, and other covalent modification of oils disclosed herein, as well as methods of distillation and fractionation (such as cold filtration) disclosed herein can be employed to generate renewable diesel compositions with other T90 values, such as T90 between 280 and 380, between 290 and 360, between 300 and 350, between 310 and 340, and at least 290.

The FBP of the material produced in Example 13 was 300° C Methods of hydrotreating, isomerization, and other covalent modification of oils disclosed herein, as well as methods of distillation and fractionation (such as cold filtration) disclosed herein, can be employed to generate renewable diesel compositions with other FBP values, such as FBP between 290 and 400, between 300 and 385, between 310 and 370, between 315 and 360, and at least 300.

Other oils provided by the methods and compositions of the invention can be subjected to combinations of hydrotreating, isomerization, and other covalent modification including oils with lipid profiles including (a) at least 1%-5%, preferably at least 4%, C8-C14; (b) at least 0.25%-1%, preferably at least 0.3%, C8; (c) at least 1%-5%, preferably at least 2%, C10; (d) at least 1%-5%, preferably at least 2%, C12; and (3) at least 20%-40%, preferably at least 30% C8-C14.

A traditional ultra-low sulfur diesel can be produced from any form of biomass by a two-step process. First, the biomass is converted to a syngas, a gaseous mixture rich in hydrogen and carbon monoxide. Then, the syngas is catalytically converted to liquids. Typically, the production of liquids is accomplished using Fischer-Tropsch (FT) synthesis. This technology applies to coal, natural gas, and heavy oils. Thus, in yet another preferred embodiment of the method for producing renewable diesel, treating the lipid composition to produce an alkane is performed by indirect liquefaction of the lipid composition.

The present invention also provides methods to produce jet fuel. Jet fuel is clear to straw colored. The most common fuel is an unleaded/paraffin oil-based fuel classified as Aeroplane A-1, which is produced to an internationally standardized set of specifications. Jet fuel is a mixture of a large number of different hydrocarbons, possibly as many as a thousand or more. The range of their sizes (molecular weights or carbon numbers) is restricted by the requirements for the product, for example, freezing point or smoke point. Kerosone-type Aeroplane fuel (including Jet A and Jet A-1) has a carbon number distribution between about 8 and 16 carbon numbers. Wide-cut or naphta-type Aeroplane fuel (including Jet B) typically has a carbon number distribution between about 5 and 15 carbons.

Both Aeroplanes (Jet A and Jet B) may contain a number of additives. Useful additives include, but are not limited to, antioxidants, antistatic agents, corrosion inhibitors, and fuel system icing inhibitor (FSII) agents. Antioxidants prevent gumming and usually, are based on alkylated phenols, for example, AO-30, AO-31, or AO-37. Antistatic agents dissipate static electricity and prevent sparking. Stadis 450 with dinonylnaphthylsulfonic acid (DINNSA) as the active ingredient, is an example. Corrosion inhibitors, e.g., DCI-4A is used for civilian and military fuels and DCI-6A is used for military fuels. FSII agents, include, e.g., Di-EGME.

In one embodiment of the invention, a jet fuel is produced by blending algal fuels with existing jet fuel. The lipids produced by the methods of the present invention can serve as feedstock to produce jet fuel. Thus, in another aspect of the present invention, a method for producing jet fuel is provided. Herewith two methods for producing jet fuel from the lipids produced by the methods of the present invention are provided: fluid catalytic cracking (FCC); and hydrodeoxygenation (HDO).

Fluid Catalytic Cracking (FCC) is one method which is used to produce olefins, especially propylene from heavy crude fractions. The lipids produced by the method of the present invention can be converted to olefins. The process involves flowing the lipids produced through an FCC zone and collecting a product stream comprised of olefins, which is useful as a jet fuel. The lipids produced are contacted with a cracking catalyst at cracking conditions to provide a product stream comprising olefins and hydrocarbons useful as jet fuel.

In one embodiment, the method for producing jet fuel comprises (a) cultivating a lipid-containing microorganism using methods disclosed herein, (b) lysing the lipid-containing microorganism to produce a lysate, (c) isolating lipid from the lysate, and (d) treating the lipid composition, whereby jet fuel is produced. In one embodiment of the method for producing a jet fuel, the lipid composition can be flowed through a fluid catalytic cracking zone, which, in one embodiment, may comprise contacting the lipid composition with a cracking catalyst at cracking conditions to provide a product stream comprising $C_2$-$C_5$ olefins.

In certain embodiments of this method, it may be desirable to remove any contaminants that may be present in the lipid composition. Thus, prior to flowing the lipid composition through a fluid catalytic cracking zone, the lipid composition is pretreated. Pretreatment may involve contacting the lipid composition with an ion-exchange resin. The ion exchange resin is an acidic ion exchange resin, such as Amberlyst™-15 and can be used as a bed in a reactor through which the lipid composition is flowed, either upflow or downflow. Other pretreatments may include mild acid washes by contacting the lipid composition with an acid, such as sulfuric, acetic, nitric, or hydrochloric acid. Contacting is done with a dilute acid solution usually at ambient temperature and atmospheric pressure.

The lipid composition, optionally pretreated, is flowed to an FCC zone where the hydrocarbonaceous components are cracked to olefins. Catalytic cracking is accomplished by contacting the lipid composition in a reaction zone with a catalyst composed of finely divided particulate material. The reaction is catalytic cracking, as opposed to hydrocracking, and is carried out in the absence of added hydrogen or the consumption of hydrogen. As the cracking reaction proceeds, substantial amounts of coke are deposited on the catalyst. The catalyst is regenerated at high temperatures by burning coke from the catalyst in a regeneration zone. Coke-containing catalyst, referred to herein as "coked catalyst", is continually transported from the reaction zone to the regeneration zone to be regenerated and replaced by essentially coke-free regenerated catalyst from the regeneration zone. Fluidization of the catalyst particles by various gaseous streams allows the transport of catalyst between the reaction zone and regeneration zone. Methods for cracking hydrocarbons, such as those of the lipid composition described herein, in a fluidized stream of catalyst, transporting catalyst between reaction and regeneration zones, and combusting coke in the regenerator are well known by those skilled in the art of FCC processes. Exemplary FCC applications and catalysts useful for cracking the lipid composition to produce $C_2$-$C_5$ olefins are described in U.S. Pat. Nos. 6,538,169, 7,288,685, which are incorporated in their entirety by reference.

Suitable FCC catalysts generally comprise at least two components that may or may not be on the same matrix. In some embodiments, both two components may be circulated throughout the entire reaction vessel. The first component generally includes any of the well-known catalysts that are used in the art of fluidized catalytic cracking, such as an active amorphous clay-type catalyst and/or a high activity, crystalline molecular sieve. Molecular sieve catalysts may be preferred over amorphous catalysts because of their much-improved selectivity to desired products. IN some preferred embodiments, zeolites may be used as the molecular sieve in the FCC processes. Preferably, the first catalyst component comprises a large pore zeolite, such as an Y-type zeolite, an active alumina material, a binder material, comprising either silica or alumina and an inert filler such as kaolin.

In one embodiment, cracking the lipid composition of the present invention, takes place in the riser section or, alternatively, the lift section, of the FCC zone. The lipid composition is introduced into the riser by a nozzle resulting in the rapid vaporization of the lipid composition. Before contacting the catalyst, the lipid composition will ordinarily have a temperature of about 149° C to about 316° C (300° F. to 600° F.). The catalyst is flowed from a blending vessel to the riser where it contacts the lipid composition for a time of abort 2 seconds or less.

The blended catalyst and reacted lipid composition vapors are then discharged from the top of the riser through an outlet and separated into a cracked product vapor stream including olefins and a collection of catalyst particles covered with substantial quantities of coke and generally referred to as "coked catalyst." In an effort to minimize the contact time of the lipid composition and the catalyst which may promote further conversion of desired products to undesirable other products, any arrangement of separators such as a swirl arm arrangement can be used to remove coked catalyst from the product stream quickly. The separator, e.g. swirl arm separator, is located in an upper portion of a chamber with a stripping zone situated in the lower portion of the chamber. Catalyst separated by the swirl arm arrangement drops down into the stripping zone. The cracked product vapor stream comprising cracked hydrocarbons including light olefins and some catalyst exit the chamber via a conduit which is in communication with cyclones. The cyclones remove remaining catalyst particles from the product vapor stream to reduce particle concentrations to very low levels. The product vapor stream then exits the top of the separating vessel. Catalyst separated by the cyclones is returned to the separating vessel and then to the stripping zone. The stripping zone removes adsorbed hydrocarbons from the surface of the catalyst by counter-current contact with steam.

Low hydrocarbon partial pressure operates to favor the production of light olefins. Accordingly, the riser pressure is set at about 172 to 241 kPa (25 to 35 psia) with a hydrocarbon partial pressure of about 35 to 172 kPa (5 to 25 psia), with a preferred hydrocarbon partial pressure of about 69 to 138 kPa (10 to 20 psia). This relatively low partial pressure for hydrocarbon is achieved by using steam as a diluent to the extent that the diluent is 10 to 55 wt-% of lipid composition and preferably about 15 wt-% of lipid composition. Other diluents such as dry gas can be used to reach equivalent hydrocarbon partial pressures.

The temperature of the cracked stream at the riser outlet will be about 510° C to 621° C (950° F. to 1150° F.). However, riser outlet temperatures above 566° C (1050° F.) make more dry gas and more olefins. Whereas, riser outlet temperatures below 566° C (1050° F.) make less ethylene and propylene. Accordingly, it is preferred to run the FCC process at a preferred temperature of about 566° C to about 630° C, preferred pressure of about 138 kPa to about 240 kPa (20 to 35 psia).

Another condition for the process is the catalyst to lipid composition ratio which can vary from about 5 to about 20 and preferably from about 10 to about 15.

In one embodiment of the method for producing a jet fuel, the lipid composition is introduced into the lift section of an FCC reactor. The temperature in the lift section will be very hot and range from about 700° C (1292° F.) to about 760° C (1400° F.) with a catalyst to lipid composition ratio of about 100 to about 150. It is anticipated that introducing the lipid composition into the lift section will produce considerable amounts of propylene and ethylene.

In another embodiment of the method for producing a jet fuel using the lipid composition or the lipids produced as described herein, the structure of the lipid composition or the lipids is broken by a process referred to as hydrodeoxygenation (HDO). HDO means removal of oxygen by means of hydrogen, that is, oxygen is removed while breaking the structure of the material. Olefinic double bonds are hydrogenated and any sulphur and nitrogen compounds are removed. Sulphur removal is called hydrodesulphurization (HDS). Pretreatment and purity of the raw materials (lipid composition or the lipids) contribute to the service life of the catalyst.

Generally in the HDO/HDS step, hydrogen is mixed with the feed stock (lipid composition or the lipids) and then the mixture is passed through a catalyst bed as a co-current flow, either as a single phase or a two phase feed stock. After the HDO/MDS step, the product fraction is separated and passed to a separate isomerzation reactor. An isomerization reactor for biological starting material is described in the literature (FI 100 248) as a co-current reactor.

The process for producing a fuel by hydrogenating a hydrocarbon feed, e.g., the lipid composition or the lipids herein, can also be performed by passing the lipid composition or the lipids as a co-current flow with hydrogen gas through a first hydrogenation zone, and thereafter the hydrocarbon effluent is further hydrogenated in a second hydrogenation zone by passing hydrogen gas to the second hydrogenation zone as a counter-current flow relative to the hydrocarbon effluent. Exemplary HDO applications and catalysts useful for cracking the lipid composition to produce $C_2$-$C_5$ olefins are described in U.S. Pat. No. 7,232,935, which is incorporated in its entirety by reference.

Typically, in the hydrodeoxygenation step, the structure of the biological component, such as the lipid composition or lipids herein, is decomposed, oxygen, nitrogen, phosphorus and sulphur compounds, and light hydrocarbons as gas are removed, and the olefinic bonds are hydrogenated. In the second step of the process, i.e. in the so-called isomerization step, isomerzation is carried out for branching the hydrocarbon chain and improving the performance of the paraffin at low temperatures.

In the first step, i.e. HDO step, of the cracking process, hydrogen gas and the lipid composition or lipids herein which are to be hydrogenated are passed to a HDO catalyst bed system either as co-current or counter-current flows, said catalyst bed system comprising one or more catalyst bed(s), preferably 1-3 catalyst beds. The HDO step is typically operated in a co-current manner. In case of a HDO catalyst bed system comprising two or more catalyst beds, one or more of the beds may be operated using the counter-current flow principle. In the HDO step, the pressure varies between 20 and 150 bar, preferably between 50 and 100 bar, and the temperature varies between 200 and 500° C, preferably in the range of 300-400° C In the HDO step, known hydrogenation catalysts containing metals from Group VII and/or VIB of the Periodic System may be used. Preferably, the hydrogenation catalysts are supported Pd, Pt, Ni, NiMo or a CoMo catalysts, the support being alumina and/or silica. Typically, NiMo/$Al_2O_3$ and CoMo/$Al_2O_3$ catalysts are used.

Prior to the HDO step, the lipid composition or lipids herein may optionally be treated by prehydrogenation under milder conditions thus avoiding side reactions of the double bonds. Such prehydrogenation is carried out in the presence of a prehydrogenation catalyst at temperatures of 50-400° C and at hydrogen pressures of 1-200 bar, preferably at a temperature between 150 and 250° C and at a hydrogen pressure between 10 and 100 bar. The catalyst may contain metals from Group VIII and/or VIB of the Periodic System. Preferably, the prehydrogenation catalyst is a supported Pd, Pt, Ni, NiMo or a CoMo catalyst, the support being alumina and/or silica.

A gaseous stream from the HDO step containing hydrogen is cooled and then carbon monoxide, carbon dioxide, nitrogen, phosphorus and sulphur compounds, gaseous light hydrocarbons and other impurities are removed therefrom. After compressing, the purified hydrogen or recycled hydrogen is returned back to the first catalyst bed and/or between the catalyst beds to make up for the withdrawn gas stream. Water is removed from the condensed liquid. The liquid is passed to the first catalyst bed or between the catalyst beds.

After the HDO step, the product is subjected to an isomerization step. It is substantial for the process that the impurities are removed as completely as possible before the hydrocarbons are contacted with the isomerization catalyst. The isomerization step comprises an optional stripping step, wherein the reaction product from the HDO step may be purified by stripping with water vapour or a suitable gas such as light hydrocarbon, nitrogen or hydrogen. The optional stripping step is carried out in counter-current manner in a unit upstream of the isomerization catalyst, wherein the gas and liquid are contacted with each other, or before the actual isomerization reactor in a separate stripping unit utilizing counter-current principle.

After the stripping step the hydrogen gas and the hydrogenated lipid composition or lipids herein, and optionally an n-paraffin mixture, are passed to a reactive isomerization unit comprising one or several catalyst bed(s). The catalyst beds of the isomerization step may operate either in co-current or counter-current manner.

It is important for the process that the counter-current flow principle is applied in the isomerization step. In the isomerization step this is done by carrying out either the optional stripping step or the isomerization reaction step or both in counter-current manner. In the isomerzation step, the pressure varies in the range of 20-150 bar, preferably in the range of 20-100 bar, the temperature being between 200 and 500° C, preferably between 300 and 400° C In the isomerization step, isomerization catalysts known in the art may be used. Suitable isomerization catalysts contain molecular sieve and/or a metal from Group VII and/or a carrier. Preferably, the isomerization catalyst contains SAPO-11 or SAPO41 or ZSM-22 or ZSM-23 or ferrierite and Pt, Pd or Ni and $Al_2O_3$ or $SiO_2$. Typical isomerization catalysts are, for example, Pt/SAPO-11/$Al_2O_3$, Pt/ZSM-22/$Al_2O_3$, Pt/ZSM-23/$Al_2O_3$ and Pt/SAPO-11/$SiO_2$. The isomerization step and the HDO step may be carried out in the same pressure vessel or in separate pressure vessels. Optional prehydrogenation may be carried out in a separate pressure vessel or in the same pressure vessel as the HDO and isomerization steps.

Thus, in one embodiment, the product of one or more chemical reactions is an alkane mixture that comprises HRJ-5. In another embodiment, the product of the one or more chemical reactions is an alkane mixture that comprises ASTM D1655 jet fuel. In some embodiments, the composition conforming to the specification of ASTM 1655 jet fuel has a sulfur content that is less than 10 ppm. In other embodiments, the composition conforming to the specification of ASTM 1655 jet fuel has a T10 value of the distillation curve of less than 205° C In another embodiment, the composition conforming to the specification of ASTM 1655 jet fuel has a final boiling point (FBP) of less than 300° C In another embodiment, the composition conforming to the specification of ASTM 1655 jet fuel has a flash point of at least 38° C In another embodiment, the composition conforming to the specification of ASTM 1655 jet fuel has a density between 775K/M$^3$ and 840 K/M$^3$. In yet another embodiment, the composition conforming to the specification of ASTM 1655 jet fuel has a freezing point that is below −47° C In another embodiment, the composition conforming to the specification of ASTM 1655 jet fuel has a net Heat of Combustion that is at least 42.8 MJ/K. In another embodiment, the composition conforming to the specification of ASTM 1655 jet fuel has a hydrogen content that is at least 13.4 mass %. In another embodiment, the composition conforming to the specification of ASTM 1655 jet fuel has a thermal stability, as tested by quantitative gravimetric JFTOT at 260° C, that is below 3 mm of Hg. In another embodiment, the composition conforming to the specification of ASTM 1655 jet fuel has an existent gum that is below 7 mg/dl.

Thus, the present invention discloses a variety of methods in which chemical modification of microalgal lipid is undertaken to yield products useful in a variety of industrial and other applications. Examples of processes for modifying oil produced by the methods disclosed herein include, but are not limited to, hydrolysis of the oil, hydroprocessing of the oil, and esterification of the oil. Other chemical modification of microalgal lipid include, without limitation, epoxidation, oxidation, hydrolysis, sulfations, sulfonation, ethoxylation, propoxylation, amidation, and saponification. The modification of the microalgal oil produces basic oleochemicals that can be further modified into selected derivative oleochemicals for a desired function. In a manner similar to that described above with reference to fuel producing processes, these chemical modifications can also be performed on oils generated from the microbial cultures described herein. Examples of basic oleochemicals include, but are not limited to, soaps, fatty acids, fatty esters, fatty alcohols, fatty nitrogen compounds, fatty acid methyl esters, and glycerol. Examples of derivative oleochemicals include, but are not limited to, fatty nitriles, esters, dimer acids, quats, surfactants, fatty alkanolamides, fatty alcohol sulfates, resins, emulsifiers, fatty alcohols, olefins, drilling muds, polyols, polyurethanes, polyacrylates, rubber, candles, cosmetics, metallic soaps, soaps, alpha-sulphonated methyl esters, fatty alcohol sulfates, fatty alcohol ethoxylates, fatty alcohol ether sulfates, imidazolines, surfactants, detergents, esters, quats, ozonolysis products, fatty amines, fatty alkanolamides, ethoxysulfates, monoglycerides, diglycerides, triglycerides (including medium chain triglycerides), lubricants, hydraulic fluids, greases, dielectric fluids, mold release agents, metal working fluids, heat transfer fluids, other functional fluids, industrial chemicals (e.g., cleaners, textile processing aids, plasticizers, stabilizers, additives), surface coatings, paints and lacquers, electrical wiring insulation, and higher alkanes.

Hydrolysis of the fatty acid constituents from the glycerolipids produced by the methods of the invention yields free fatty acids that can be derivatized to produce other useful chemicals. Hydrolysis occurs in the presence of water and a catalyst which may be either an acid or a base. The liberated free fatty acids can be derivatized to yield a variety of products, as reported in the following: U.S. Pat. Nos. 5,304,664 (Highly sulfated fatty acids); 7,262,158 (Cleansing compositions); 7,115,173 (Fabric softener compositions); 6,342,208 (Emulsions for treating skin); 7,264,886 (Water repellant compositions); 6,924,333 (Paint additives); 6,596,768 (Lipid-enriched ruminant feedstock); and 6,380,410 (Surfactants for detergents and cleaners).

With regard to hydrolysis, in one embodiment of the invention, a triglyceride oil is optionally first hydrolyzed in a liquid medium such as water or sodium hydroxide so as to obtain glycerol and soaps. There are various suitable triglyceride hydrolysis methods, including, but not limited to, saponification, acid hydrolysis, alkaline hydrolysis, enzymatic hydrolysis (referred herein as splitting), and hydrolysis using hot-compressed water. One skilled in the art will recognize that a triglyceride oil need not be hydrolyzed in order to produce an oleochemical; rather, the oil may be converted directly to the desired oleochemical by other known process. For example, the triglyceride oil may be directly converted to a methyl ester fatty acid through esterification.

In some embodiments, catalytic hydrolysis of the oil produced by methods disclosed herein occurs by splitting the oil into glycerol and fatty acids. As discussed above, the fatty acids may then be further processed through several other modifications to obtained derivative oleochemicals. For example, in one embodiment the fatty acids may undergo an amination reaction to produce fatty nitrogen compounds. In another embodiment, the fatty acids may undergo ozonolysis to produce mono- and dibasic-acids.

In other embodiments hydrolysis may occur via the, splitting of oils produced herein to create oleochemicals. In some preferred embodiments of the invention, a triglyceride oil may be split before other processes is performed. One skilled in the art will recognize that there are many suitable triglyceride splitting methods, including, but not limited to, enzymatic splitting and pressure splitting.

Generally, enzymatic oil splitting methods use enzymes, lipases, as biocatalysts acting on a water/oil mixture. Enzymatic splitting then slpits the oil or fat, respectively, is into glycerol and free fatty acids. The glycerol may then migrates into the water phase whereas the organic phase enriches with free fatty acids.

The enzymatic splitting reactions generally take place at the phase boundary between organic and aqueous phase, where the enzyme is present only at the phase boundary. Triglycerides that meet the phase boundary then contribute to or participate in the splitting reaction. As the reaction proceeds, the occupation density or concentration of fatty acids still chemically bonded as glycerides, in comparison to free fatty acids, decreases at the phase boundary so that the reaction is slowed down. In certain embodiments, enzymatic splitting may occur at room temperature. One of ordinary skill in the art would know the suitable conditions for splitting oil into the desired fatty acids.

By way of example, the reaction speed can be accelerated by increasing the interface boundary surface. Once the reaction is complete, free fatty acids are then separated from the organic phase freed from enzyme, and the residue which still contains fatty acids chemically bonded as glycerides is fed back or recycled and mixed with fresh oil or fat to be subjected to splitting. In this manner, recycled glycerides are then subjected to a further enzymatic splitting process. In some embodiments, the free fatty acids are extracted from an oil or fat partially split in such a manner. In that way, if the chemically bound fatty acids (triglycerides) are returned or fed back into the splitting process, the enzyme consumption can be drastically reduced.

The splitting degree is determined as the ratio of the measured acid value divided by the theoretically possible acid value which can be computed for a given oil or fat. Preferably, the acid value is measured by means of titration according to standard common methods. Alternatively, the density of the aqueous glycerol phase can be taken as a measure for the splitting degree.

In one embodiment, the slitting process as described herein is also suitable for splitting the mono-, di- and triglyceride that are contained in the so-called soap-stock from the alkali refining processes of the produced oils. In this manner, the soap-stock can be quantitatively converted without prior saponification of the neutral oils into the fatty acids. For this purpose, the fatty acids being chemically bonded in the soaps are released, preferably before splitting, through an addition of acid. In certain embodiments, a buffer solution is used in addition to water and enzyme for the splitting process.

In one embodiment, oils produced in accordance with the methods of the invention can also be subjected to saponification as a method of hydrolysis Animal and plant oils are typically made of triacylglycerols (TAGs), which are esters of fatty acids with the trihydric alcohol, glycerol. In an alkaline hydrolysis reaction, the glycerol in a TAG is removed, leaving three carboxylic acid anions that can associate with alkali metal cations such as sodium or potassium to produce fatty acid salts. In this scheme, the carboxylic acid constituents are cleaved from the glycerol moiety and replaced with hydroxyl groups. The quantity of base (e.g., KOH) that is used in the reaction is determined by the desired degree of saponification. If the objective is, for example, to produce a soap product that comprises some of the oils originally present in the TAG composition, an amount of base insufficient to convert all of the TAGs to fatty acid salts is introduced into the reaction mixture. Normally, this reaction is performed in an aqueous solution and proceeds slowly, but may be expedited by the addition of heat. Precipitation of the fatty acid salts can be facilitated by addition of salts, such as water-soluble alkali metal halides (e.g., NaCl or KCl), to the reaction mixture. Preferably, the base is an alkali metal hydroxide, such as NaOH or KOH. Alternatively, other bases, such as alkanolamines, including for example triethanolamine and aminomethylpropanol, can be used in the reaction scheme. In some cases, these alternatives may be preferred to produce a clear soap product. In one embodiment the lipid composition subjected to saponification is a tallow mimetic (i.e., lipid composition similar to that of tallow) produced as described herein, or a blend of a tallow mimetic with another triglyceride oil.

In some methods, the first step of chemical modification may be hydroprocessing to saturate double bonds, followed by deoxygenation at elevated temperature in the presence of hydrogen and a catalyst. In other methods, hydrogenation and deoxygenation may occur in the same reaction. In still other methods deoxygenation occurs before hydrogenation. Isomerization may then be optionally performed, also in the presence of hydrogen and a catalyst. Finally, gases and naphtha components can be removed if desired. For example, see U.S. Pat. Nos. 5,475,160 (hydrogenation of triglycerides); 5,091,116 (deoxygenation, hydrogenation and gas removal); 6,391,815 (hydrogenation); and 5,888,947 (isomerization).

In some embodiments of the invention, the triglyceride oils are partially or completely deoxygenated. The deoxygenation reactions form desired products, including, but not limited to, fatty acids, fatty alcohols, polyols, ketones, and aldehydes. In general, without being limited by any particular theory, the deoxygenation reactions involve a combination of various different reaction pathways, including without limitation: hydrogenolysis, hydrogenation, consecutive hydrogenation-hydrogenolysis, consecutive hydrogenolysis-hydrogenation, and combined hydrogenation-hydrogenolysis reactions, resulting in at least the partial removal of oxygen from the fatty acid or fatty acid ester to produce reaction products, such as fatty alcohols, that can be easily converted to the desired chemicals by further processing. For example, in one embodiment, a fatty alcohol may be converted to olefins through FCC reaction or to higher alkanes through a condensation reaction.

One such chemical modification is hydrogenation, which is the addition of hydrogen to double bonds in the fatty acid constituents of glycerolipids or of free fatty acids. The hydrogenation process permits the transformation of liquid oils into semi-solid or solid fats, which may be more suitable for specific applications.

Hydrogenation of oil produced by the methods described herein can be performed in conjunction with one or more of the methods and/or materials provided herein, as reported in the following: U.S. Pat. Nos. 7,288,278 (Food additives or medicaments); 5,346,724 (Lubrication products); 5,475,160 (Fatty alcohols); 5,091,116 (Edible oils); 6,808,737 (Structural fats for margarine and spreads); 5,298,637 (Reduced-calorie fat substitutes); 6,391,815 (Hydrogenation catalyst and sulfur adsorbent); 5,233,099 and 5,233,100 (Fatty alcohols); 4,584,139 (Hydrogenation catalysts); 6,057,375 (Foam suppressing agents); and 7,118,773 (Edible emulsion spreads).

One skilled in the art will recognize that various processes may be used to hydrogenate carbohydrates. One suitable method includes contacting the carbohydrate with hydrogen or hydrogen mixed with a suitable gas and a catalyst under conditions sufficient in a hydrogenation reactor to form a hydrogenated product. The hydrogenation catalyst generally can include Cu, Re, Ni, Fe, Co, Ru, Pd, Rh, Pt, Os, Ir, and alloys or any combination thereof, either alone or with promoters such as W, Mo, Au, Ag, Cr, Zn, Mn, Sn, B, P, Bi, and alloys or any combination thereof. Other effective hydrogenation catalyst materials include either supported nickel or ruthenium modified with rhenium. In an embodiment, the hydrogenation catalyst also includes any one of the supports, depending on the desired functionality of the catalyst. The hydrogenation catalysts may be prepared by methods known to those of ordinary skill in the art.

In some embodiments the hydrogenation catalyst includes a supported Group VIII metal catalyst and a metal sponge material (e.g., a sponge nickel catalyst). Raney nickel provides an example of an activated sponge nickel catalyst suitable for use in this invention. In other embodiment, the hydrogenation reaction in the invention is performed using a catalyst comprising a nickel-rhenium catalyst or a tungsten-modified nickel catalyst. One example of a suitable catalyst for the hydrogenation reaction of the invention is a carbon-supported nickel-rhenium catalyst.

In an embodiment, a suitable Raney nickel catalyst may be prepared by treating an alloy of approximately equal amounts by weight of nickel and aluminum with an aqueous alkali solution, e.g., containing about 25 weight % of sodium hydroxide. The aluminum is selectively dissolved by the aqueous alkali solution resulting in a sponge shaped material comprising mostly nickel with minor amounts of aluminum. The initial alloy includes promoter metals (i.e., molybdenum or chromium) in the amount such that about 1 to 2 weight % remains in the formed sponge nickel catalyst. In another embodiment, the hydrogenation catalyst is prepared using a solution of ruthenium(III) nitrosylnitrate, ruthenium (III) chloride in water to impregnate a suitable support material. The solution is then dried to form a solid having a water content of less than about 1% by weight. The solid may then be reduced at atmospheric pressure in a hydrogen stream at 300° C (uncalcined) or 400° C (calcined) in a rotary ball furnace for 4 hours. After cooling and rendering the catalyst inert with nitrogen, 5% by volume of oxygen in nitrogen is passed over the catalyst for 2 hours.

In certain embodiments, the catalyst described includes a catalyst support. The catalyst support stabilizes and supports the catalyst. The type of catalyst support used depends on the chosen catalyst and the reaction conditions. Suitable supports for the invention include, but are not limited to, carbon, silica, silica-alumina, zirconia, titania, ceria, vanadia, nitride, boron nitride, heteropolyacids, hydroxyapatite, zinc oxide, chromia, zeolites, carbon nanotubes, carbon fullerene and any combination thereof.

The catalysts used in this invention can be prepared using conventional methods known to those in the art. Suitable methods may include, but are not limited to, incipient wetting, evaporative impregnation, chemical vapor deposition, wash-coating, magnetron sputtering techniques, and the like.

The conditions for which to carry out the hydrogenation reaction will vary based on the type of starting material and the desired products. One of ordinary skill in the art, with the benefit of this disclosure, will recognize the appropriate reaction conditions. In general, the hydrogenation reaction is conducted at temperatures of 80° C to 250° C, and preferably at 90° C to 200° C, and most preferably at 100° C to 150° C In some embodiments, the hydrogenation reaction is conducted at pressures from 500 KPa to 14000 KPa.

The hydrogen used in the hydrogenolysis reaction of the current invention may include external hydrogen, recycled hydrogen, in situ generated hydrogen, and any combination thereof. As used herein, the term "external hydrogen" refers to hydrogen that does not originate from the biomass reaction itself, but rather is added to the system from another source.

In some embodiments of the invention, it is desirable to convert the starting carbohydrate to a smaller molecule that will be more readily converted to desired higher hydrocarbons. One suitable method for this conversion is through a hydrogenolysis reaction. Various processes are known for performing hydrogenolysis of carbohydrates. One suitable method includes contacting a carbohydrate with hydrogen or hydrogen mixed with a suitable gas and a hydrogenolysis catalyst in a hydrogenolysis reactor under conditions sufficient to form a reaction product comprising smaller molecules or polyols. As used herein, the term "smaller molecules or polyols" includes any molecule that has a smaller molecular weight, which can include a smaller number of carbon atoms or oxygen atoms than the starting carbohydrate. In an embodiment, the reaction products include smaller molecules that include polyols and alcohols. Someone of ordinary skill in the art would be able to choose the appropriate method by which to carry out the hydrogenolysis reaction.

In some embodiments, a 5 and/or 6 carbon sugar or sugar alcohol may be converted to propylene glycol, ethylene glycol, and glycerol using a hydrogenolysis catalyst. The hydrogenolysis catalyst may include Cr, Mo, W, Re, Mn, Cu, Cd, Fe, Co, Ni, Pt, Pd, Rh, Ru, Ir, Os, and alloys or any combination thereof, either alone or with promoters such as Au, Ag, Cr, Zn, Mn, Sn, Bi, B, O, and alloys or any combination thereof. The hydrogenolysis catalyst may also include a carbonaceous pyropolymer catalyst containing transition metals (e.g., chromium, molybdemum, tungsten, rhenium, manganese, copper, cadmium) or Group VIII metals (e.g., iron, cobalt, nickel, platinum, palladium, rhodium, ruthenium, iridium, and osmium). In certain embodiments, the hydrogenolysis catalyst may include any of the above metals combined with an alkaline earth metal oxide or adhered to a catalytically active support. In certain embodiments, the catalyst described in the hydrogenolysis reaction may include a catalyst support as described above for the hydrogenation reaction.

The conditions for which to carry out the hydrogenolysis reaction will vary based on the type of starting material and the desired products. One of ordinary skill in the art, with the benefit of this disclosure, will recognize the appropriate conditions to use to carry out the reaction. In general, they hydrogenolysis reaction is conducted at temperatures of 110° C to 300° C, and preferably at 170° C to 220° C, and most preferably at 200° C to 225° C In some embodiments, the hydrogenolysis reaction is conducted under basic conditions, preferably at a pH of 8 to 13, and even more preferably at a pH of 10 to 12. In some embodiments, the hydrogenolysis reaction is conducted at pressures in a range between 60 KPa and 16500 KPa, and preferably in a range between 1700 KPa and 14000 KPa, and even more preferably between 4800 KPa and 11000 KPa.

The hydrogen used in the hydrogenolysis reaction of the current invention can include external hydrogen, recycled hydrogen, in situ generated hydrogen, and any combination thereof.

In some embodiments, the reaction products discussed above may be converted into higher hydrocarbons through a condensation reaction in a condensation reactor. In such embodiments, condensation of the reaction products occurs in the presence of a catalyst capable of forming higher hydrocarbons. While not intending to be limited by theory, it is believed that the production of higher hydrocarbons proceeds through a stepwise addition reaction including the formation of carbon-carbon, or carbon-oxygen bond. The resulting reaction products include any number of compounds containing these moieties, as described in more detail below.

In certain embodiments, suitable condensation catalysts include an acid catalyst, a base catalyst, or an acid/base catalyst. As used herein, the term "acid/base catalyst" refers to a catalyst that has both an acid and a base functionality. In some embodiments the condensation catalyst can include, without limitation, zeolites, carbides, nitrides, zirconia, alumina, silica, aluminosilicates, phosphates, titanium oxides, zinc oxides, vanadium oxides, lanthanum oxides, yttrium oxides, scandium oxides, magnesium oxides, cerium oxides, barium oxides, calcium oxides, hydroxides, heteropolyacids, inorganic acids, acid modified resins, base modified resins, and any combination thereof. In some embodiments, the condensation catalyst can also include a modifier. Suitable modifiers include La, Y, Sc, P, B, Bi, Li, Na, K, Rb, Cs, Mg, Ca, Sr, Ba, and any combination thereof. In some embodiments, the condensation catalyst can also include a metal. Suitable metals include Cu, Ag, Au, Pt, Ni, Fe, Co, Ru, Zn, Cd, Ga, In, Rh, Pd, Ir, Re, Mn, Cr, Mo, W, Sn, Os, alloys, and any combination thereof.

In certain embodiments, the catalyst described in the condensation reaction may include a catalyst support as described above for the hydrogenation reaction. In certain embodiments, the condensation catalyst is self-supporting. As used herein, the term "self-supporting" means that the catalyst does not need another material to serve as support. In other embodiments, the condensation catalyst in used in conjunction with a separate support suitable for suspending the catalyst. In an embodiment, the condensation catalyst support is silica.

The conditions under which the condensation reaction occurs will vary based on the type of starting material and the desired products. One of ordinary skill in the art, with the benefit of this disclosure, will recognize the appropriate conditions to use to carry out the reaction. In some embodiments, the condensation reaction is carried out at a temperature at which the thermodynamics for the proposed reaction are favorable. The temperature for the condensation reaction will vary depending on the specific starting polyol or alcohol. In some embodiments, the temperature for the condensation reaction is in a range from 80° C to 500° C, and preferably from 125° C to 450° C, and most preferably from 125° C to 250° C In some embodiments, the condensation reaction is conducted at pressures in a range between 0 Kpa to 9000 KPa, and preferably in a range between 0 KPa and 7000 KPa, and even more preferably between 0 KPa and 5000 KPa.

The higher alkanes formed by the invention include, but are not limited to, branched or straight chain alkanes that have from 4 to 30 carbon atoms, branched or straight chain alkenes that have from 4 to 30 carbon atoms, cycloalkanes that have from 5 to 30 carbon atoms, cycloalkenes that have from 5 to 30 carbon atoms, aryls, fused aryls, alcohols, and ketones. Suitable alkanes include, but are not limited to, butane, pentane, pentene, 2-methylbutane, hexane, hexene, 2-methylpentane, 3-methylpentane, 2,2,-dimethylbutane, 2,3-dimethylbutane, heptane, heptene, octane, octene, 2,2,4-trimethylpentane, 2,3-dimethyl hexane, 2,3,4-trimethylpentane, 2,3-dimethylpentane, nonane, nonene, decane, decene, undecane, undecene, dodecane, dodecene, tridecane, tridecene, tetradecane, tetradecene, pentadecane, pentadecene, nonyldecane, nonyldecene, eicosane, eicosene, uneicosane, uneicosene, doeicosane, doeicosene, trieicosane, trieicosene, tetraeicosane, tetraeicosene, and isomers thereof. Some of these products may be suitable for use as fuels.

In some embodiments, the cycloalkanes and the cycloalkenes are unsubstituted. In other embodiments, the cycloalkanes and cycloalkenes are mono-substituted. In still other embodiments, the cycloalkanes and cycloalkenes are multi-substituted. In the embodiments comprising the substituted cycloalkanes and cycloalkenes, the substituted group includes, without limitation, a branched or straight chain alkyl having 1 to 12 carbon atoms, a branched or straight chain alkylene having 1 to 12 carbon atoms, a phenyl, and any combination thereof. Suitable cycloalkanes and cycloalkenes include, but are not limited to, cyclopentane, cyclopentene, cyclohexane, cyclohexene, methyl-cyclopentane, methyl-cyclopentene, ethyl-cyclopentane, ethyl-cyclopentene, ethyl-cyclohexane, ethyl-cyclohexene, isomers and any combination thereof.

In some embodiments, the aryls formed are unsubstituted. In another embodiment, the aryls formed are mono-substituted. In the embodiments comprising the substituted aryls, the substituted group includes, without limitation, a branched or straight chain alkyl having 1 to 12 carbon atoms, a branched or straight chain alkylene having 1 to 12 carbon atoms, a phenyl, and any combination thereof. Suitable aryls for the invention include, but are not limited to, benzene, toluene, xylene, ethyl benzene, para xylene, meta xylene, and any combination thereof.

The alcohols produced in the invention have from 4 to 30 carbon atoms. In some embodiments, the alcohols are cyclic. In other embodiments, the alcohols are branched. In another embodiment, the alcohols are straight chained. Suitable alcohols for the invention include, but are not limited to, butanol, pentanol, hexanol, heptanol, octanol, nonanol, decanol, undecanol, dodecanol, tridecanol, tetradecanol, pentadecanol, hexadecanol, heptyldecanol, octyldecanol, nonyldecanol, eicosanol, uneicosanol, doeicosanol, trieicosanol, tetraeicosanol, and isomers thereof.

The ketones produced in the invention have from 4 to 30 carbon atoms. In an embodiment, the ketones are cyclic. In another embodiment, the ketones are branched. In another embodiment, the ketones are straight chained. Suitable ketones for the invention include, but are not limited to, butanone, pentanone, hexanone, heptanone, octanone, nonanone, decanone, undecanone, dodecanone, tridecanone, tetradecanone, pentadecanone, hexadecanone, heptyldecanone, octyldecanone, nonyldecanone, eicosanone, uneicosanone, doeicosanone, trieicosanone, tetraeicosanone, and isomers thereof.

Another such chemical modification is interesterification. Naturally produced glycerolipids do not have a uniform distribution of fatty acid constituents. In the context of oils, interesterification refers to the exchange of acyl radicals between two esters of different glycerolipids. The interesterification process provides a mechanism by which the fatty acid constituents of a mixture of glycerolipids can be rearranged to modify the distribution pattern. Interesterification is a well-known chemical process, and generally comprises heating (to about 200° C) a mixture of oils for a period (e.g, 30 minutes) in the presence of a catalyst, such as an alkali metal or alkali metal alkylate (e.g., sodium methoxide). This process can be used to randomize the distribution pattern of the fatty acid constituents of an oil mixture, or can be directed to produce a desired distribution pattern. This method of chemical modification of lipids can be performed on materials provided herein, such as microbial biomass with a percentage of dry cell weight as lipid at least 20%.

Directed interesterification, in which a specific distribution pattern of fatty acids is sought, can be performed by maintaining the oil mixture at a temperature below the melting point of some TAGs which might occur. This results in selective crystallization of these TAGs, which effectively removes them from the reaction mixture as they crystallize. The process can be continued until most of the fatty acids in the oil have precipitated, for example. A directed interesterification process can be used, for example, to produce a product with a lower calorie content via the substitution of longer-chain fatty acids with shorter-chain counterparts. Directed interesterification can also be used to produce a product with a mixture of fats that can provide desired melting characteristics and structural features sought in food additives or products (e.g., margarine) without resorting to hydrogenation, which can produce unwanted trans isomers.

Interesterification of oils produced by the methods described herein can be performed in conjuction with one or more of the methods and/or materials, or to produce products, as reported in the following: U.S. Pat. Nos. 6,080,853 (Non-digestible fat substitutes); 4,288,378 (Peanut butter stabilizer); 5,391,383 (Edible spray oil); 6,022,577 (Edible fats for food products); 5,434,278 (Edible fats for food products); 5,268,192 (Low calorie nut products); 5,258,197 (Reduce calorie edible compositions); 4,335,156 (Edible fat product); 7,288,278 (Food additives or medicaments); 7,115,760 (Fractionation process); 6,808,737 (Structural fats); 5,888,947 (Engine lubricants); 5,686,131 (Edible oil mixtures); and 4,603,188 (Curable urethane compositions).

In one embodiment in accordance with the invention, transesterification of the oil, as described above, is followed by reaction of the transesterified product with polyol, as reported in U.S. Pat. No. 6,465,642, to produce polyol fatty acid polyesters. Such an esterification and separation process may comprise the steps as follows: reacting a lower alkyl ester with polyol in the presence of soap; removing residual soap from the product mixture; water-washing and drying the product mixture to remove impurities; bleaching the product mixture for refinement; separating at least a portion of the unreacted lower alkyl ester from the polyol fatty acid polyester in the product mixture; and recycling the separated unreacted lower alkyl ester.

Transesterification can also be performed on microbial biomass with short chain fatty acid esters, as reported in U.S. Pat. No. 6,278,006. In general, transesterification may be performed by adding a short chain fatty acid ester to an oil in the presence of a suitable catalyst and heating the mixture. In some embodiments, the oil comprises about 5% to about 90% of the reaction mixture by weight. In some embodiments, the short chain fatty acid esters can be about 10% to about 50% of the reaction mixture by weight. Non-limiting examples of catalysts include base catalysts, sodium methoxide, acid catalysts including inorganic acids such as sulfuric acid and acidified clays, organic acids such as methane sulfonic acid, benzenesulfonic acid, and toluenesulfonic acid, and acidic resins such as Amberlyst 15. Metals such as sodium and magnesium, and metal hydrides also are useful catalysts.

Another such chemical modification is hydroxylation, which involves the addition of water to a double bond resulting in saturation and the incorporation of a hydroxyl moiety. The hydroxylation process provides a mechanism for converting one or more fatty acid constituents of a glycerolipid to a hydroxy fatty acid. Hydroxylation can be performed, for example, via the method reported in U.S. Pat. No. 5,576,027. Hydroxylated fatty acids, including castor oil and its derivatives, are useful as components in several industrial applications, including food additives, surfactants, pigment wetting agents, defoaming agents, water proofing additives, plasticizing agents, cosmetic emulsifying and/or deodorant agents, as well as in electronics, pharmaceuticals, paints, inks, adhesives, and lubricants. One example of how the hydroxylation of a glyceride may be performed is as follows: fat may be heated, preferably to about 30-50° C combined with heptane and maintained at temperature for thirty minutes or more; acetic acid may then be added to the mixture followed by an aqueous solution of sulfuric acid followed by an aqueous hydrogen peroxide solution which is added in small increments to the mixture over one hour; after the aqueous hydrogen peroxide, the temperature may then be increased to at least about 60° C and stirred for at least six hours; after the stirring, the mixture is allowed to settle and a lower aqueous layer formed by the reaction may be removed while the upper heptane layer formed by the reaction may be washed with hot water having a temperature of about 60° C; the washed heptane layer may then be neutralized with an aqueous potassium hydroxide solution to a pH of about 5 to 7 and then removed by distillation under vacuum; the reaction product may then be dried under vacuum at 100° C and the dried product steam-deodorized under vacuum conditions and filtered at about 50° to 60° C using diatomaceous earth.

Hydroxylation of microbial oils produced by the methods described herein can be performed in conjuction with one or more of the methods and/or materials, or to produce products, as reported in the following: U.S. Pat. Nos. 6,590,113 (Oil-based coatings and ink); 4,049,724 (Hydroxylation process); 6,113,971 (Olive oil butter); 4,992,189 (Lubricants and lube additives); 5,576,027 (Hydroxylated milk); and 6,869,597 (Cosmetics).

Hydroxylated glycerolipids can be converted to estolides. Estolides consist of a glycerolipid in which a hydroxylated fatty acid constituent has been esterified to another fatty acid molecule. Conversion of hydroxylated glycerolipids to estolides can be carried out by warming a mixture of glycerolipids and fatty acids and contacting the mixture with a mineral acid, as described by Isbell et al., *JAOCS* 71(2):169-174 (1994). Estolides are useful in a variety of applications, including without limitation those reported in the following: U.S. Pat. Nos. 7,196,124 (Elastomeric materials and floor coverings); 5,458,795 (Thickened oils for high-temperature applications); 5,451,332 (Fluids for industrial applications); 5,427,704 (Fuel additives); and 5,380,894 (Lubricants, greases, plasticizers, and printing inks).

Another such chemical modification is olefin metathesis. In olefin metathesis, a catalyst severs the alkylidene carbons in an alkene (olefin) and forms new alkenes by pairing each of them with different alkylidine carbons. The olefin metathesis reaction provides a mechanism for processes such as truncating unsaturated fatty acid alkyl chains at alkenes by ethenolysis, cross-linking fatty acids through alkene linkages by self-metathesis, and incorporating new functional groups on fatty acids by cross-metathesis with derivatized alkenes.

In conjunction with other reactions, such as transesterification and hydrogenation, olefin metathesis can transform unsaturated glycerolipids into diverse end products. These products include glycerolipid oligomers for waxes; short-chain glycerolipids for lubricants; homo- and hetero-bifunctional alkyl chains for chemicals and polymers; short-chain esters for biofuel; and short-chain hydrocarbons for jet fuel. Olefin metathesis can be performed on triacylglycerols and fatty acid derivatives, for example, using the catalysts and methods reported in U.S. Pat. No. 7,119,216, US Patent Pub. No. 2010/0160506, and U.S. Patent Pub. No. 2010/0145086.

Olefin metathesis of bio-oils generally comprises adding a solution of Ru catalyst at a loading of about 10 to 250 ppm under inert conditions to unsaturated fatty acid esters in the presence (cross-metathesis) or absence (self-metathesis) of other alkenes. The reactions are typically allowed to proceed from hours to days and ultimately yield a distribution of alkene products. One example of how olefin metathesis may be performed on a fatty acid derivative is as follows: A solution of the first generation Grubbs Catalyst (dichloro[2(1-methylethoxy-α-O)phenyl]methylene-α-C] (tricyclohexylphosphine) in toluene at a catalyst loading of 222 ppm may be added to a vessel containing degassed and dried methyl oleate. Then the vessel may be pressurized with about 60 psig of ethylene gas and maintained at or below about 30° C for 3 hours, whereby approximately a 50% yield of methyl 9-decenoate may be produced.

Olefin metathesis of oils produced by the methods described herein can be performed in conjunction with one or more of the methods and/or materials, or to produce products, as reported in the following: Patent App. PCT/US07/081,427 (α-olefin fatty acids) and U.S. patent application Ser. Nos. 12/281,938 (petroleum creams), 12/281,931 (paintball gun capsules), 12/653,742 (plasticizers and lubricants), 12/422,096 (bifunctional organic compounds), and 11/795,052 (candle wax).

Other chemical reactions that can be performed on microbial oils include reacting triacylglycerols with a cyclopropanating agent to enhance fluidity and/or oxidative stability, as reported in U.S. Pat. No. 6,051,539; manufacturing of waxes from triacylglycerols, as reported in U.S. Pat. No. 6,770,104; and epoxidation of triacylglycerols, as reported in "The effect of fatty acid composition on the acrylation kinetics of epoxidized triacylglycerols", Journal of the American Oil Chemists' Society, 79:1, 59-63, (2001) and Free Radical Biology and Medicine, 37:1, 104-114 (2004).

The generation of oil-bearing microbial biomass for fuel and chemical products as described above results in the production of delipidated biomass meal. Delipidated meal is a byproduct of preparing algal oil and is useful as animal feed for farm animals, e.g., ruminants, poultry, swine and aquaculture. The resulting meal, although of reduced oil content, still contains high quality proteins, carbohydrates, fiber, ash, residual oil and other nutrients appropriate for an animal feed. Because the cells are predominantly lysed by the oil separation process, the delipidated meal is easily digestible by such animals. Delipidated meal can optionally be combined with other ingredients, such as grain, in an animal feed. Because delipidated meal has a powdery consistency, it can be pressed into pellets using an extruder or expander or another type of machine, which are commercially available.

The invention, having been described in detail above, is exemplified in the following examples, which are offered to illustrate, but not to limit, the claimed invention.

VII. EXAMPLES

Example 1

Methods for Culturing *Prototheca*

*Prototheca* strains were cultivated to achieve a high percentage of oil by dry cell weight. Cryopreserved cells were thawed at room temperature and 500 ul of cells were added to 4.5 ml of medium (4.2 g/L $K_2HPO_4$, 3.1 g/L $NaH_2PO_4$, 0.24 g/L $MgSO_4 \cdot 7H_2O$, 0.25 g/L Citric Acid monohydrate, 0.025 g/L $CaCl_2 \cdot 2H_2O$, 2 g/L yeast extract) plus 2% glucose and grown for 7 days at 28° C with agitation (200 rpm) in a 6-well plate. Dry cell weights were determined by centrifuging 1 ml of culture at 14,000 rpm for 5 mM in a pre-weighed Eppendorf tube. The culture supernatant was discarded and the resulting cell pellet washed with 1 ml of deionized water. The culture was again centrifuged, the supernatant discarded, and the cell pellets placed at −80° C until frozen. Samples were then lyophilized for 24 hrs and dry cell weights calculated. For determination of total lipid in cultures, 3 ml of culture was removed and subjected to analysis using an Ankom system (Ankom Inc., Macedon, N.Y.) according to the manufacturer's protocol. Samples were subjected to solvent extraction with an Amkom XT10 extractor according to the manufacturer's protocol. Total lipid was determined as the difference in mass between acid hydrolyzed dried samples and solvent extracted, dried samples. Percent oil dry cell weight measurements are shown in Table 10.

TABLE 10

Percent oil by dry cell weight

| Species | Strain | % Oil |
|---|---|---|
| Prototheca stagnora | UTEX 327 | 13.14 |
| Prototheca moriformis | UTEX 1441 | 18.02 |
| Prototheca moriformis | UTEX 1435 | 27.17 |

Microalgae samples from multiple strains from the genus *Prototheca* were genotyped. Genomic DNA was isolated from algal biomass as follows. Cells (approximately 200 mg) were centrifuged from liquid cultures 5 minutes at 14,000×g. Cells were then resuspended in sterile distilled water, centrifuged 5 minutes at 14,000×g and the supernatant discarded. A single glass bead ~2 mm in diameter was added to the biomass and tubes were placed at −80° C for at least 15 minutes. Samples were removed and 150 µl of grinding buffer (1% Sarkosyl, 0.25 M Sucrose, 50 mM NaCl, 20 mM EDTA, 100 mM Tris-HCl, pH 8.0, RNase A 0.5 ug/ul) was added. Pellets were resuspended by vortexing briefly, followed by the addition of 40 ul of 5M NaCl. Samples were vortexed briefly, followed by the addition of 66 µl of 5% CTAB (Cetyl trimethylammonium bromide) and a final brief vortex. Samples were next incubated at 65° C for 10 minutes after which they were centrifuged at 14,000×g for 10 minutes. The supernatant was transferred to a fresh tube and extracted once with 300 µl of Phenol:Chloroform:Isoamyl alcohol 12:12:1, followed by centrifugation for 5 minutes at 14,000×g. The resulting aqueous phase was transferred to a fresh tube containing 0.7 vol of isopropanol (~190 µl), mixed by inversion and incubated at room temperature for 30 minutes or overnight at 4° C DNA was recovered via centrifugation at 14,000×g for 10 minutes. The resulting pellet was then washed twice with 70% ethanol, followed by a final wash with 100% ethanol. Pellets were air dried for 20-30 minutes at room temperature followed by resuspension in 50 µl of 10 mM TrisCl, 1 mM EDTA (pH 8.0).

Five µl of total algal DNA, prepared as described above, was diluted 1:50 in 10 mM Tris, pH 8.0. PCR reactions, final volume 20 µl, were set up as follows. Ten µl of 2× iProof HF master mix (BIO-RAD) was added to 0.4 µl primer SZ02613 (5'-TGTTGAAGAATGAGCCGGCGAC-3' (SEQ ID NO:9) at 10 mM stock concentration). This primer sequence runs from position 567-588 in Gen Bank accession no. L43357 and is highly conserved in higher plants and algal plastid genomes. This was followed by the addition of 0.4 µl primer SZ02615 (5'-CAGTGAGCTATTACGCACTC-3' (SEQ ID NO:10) at 10 mM stock concentration). This primer sequence is complementary to position 1112-1093 in Gen Bank accession no. L43357 and is highly conserved in higher plants and algal plastid genomes. Next, 5 µl of diluted total DNA and 3.2 µl $dH_2O$ were added. PCR reactions were run as follows: 98° C, 45"; 98° C, 8"; 53° C, 12"; 72° C, 20" for 35 cycles followed by 72° C for 1 min and holding at 25° C For purification of PCR products, 20 µl of 10 mM Tris, pH 8.0, was added to each reaction, followed by extraction with 40 µl of Phenol:Chloroform:isoamyl alcohol 12:12:1, vortexing and centrifuging at 14,000×g for 5 minutes. PCR reactions were applied to S-400 columns (GE Healthcare) and centrifuged for 2 minutes at 3,000×g. Purified PCR products were subsequently TOPO cloned into PCR8/GW/TOPO and positive clones selected for on LB/Spec plates. Purified plasmid DNA was sequenced in both directions using M13 forward and reverse primers. In total, twelve *Prototheca* strains were selected to have their 23S rRNA DNA sequenced and the sequences are listed in the Sequence Listing. A summary of the strains and Sequence Listing Numbers is included below. The sequences were analyzed for overall divergence from the UTEX 1435 (SEQ ID NO: 15) sequence. Two pairs emerged (UTEX 329/UTEX 1533 and UTEX 329/UTEX 1440) as the most divergent. In both cases, pairwise alignment resulted in 75.0% pairwise sequence identity. The percent sequence identity to UTEX 1435 is also included below:

| Species | Strain | % nt identity | SEQ ID NO. |
|---|---|---|---|
| Prototheca kruegani | UTEX 329 | 75.2 | SEQ ID NO: 11 |
| Prototheca wickerhamii | UTEX 1440 | 99 | SEQ ID NO: 12 |
| Prototheca stagnora | UTEX 1442 | 75.7 | SEQ ID NO: 13 |
| Prototheca moriformis | UTEX 288 | 75.4 | SEQ ID NO: 14 |
| Prototheca moriformis | UTEX 1439; 1441; 1435; 1437 | 100 | SEQ ID NO: 15 |
| Prototheca wikerhamii | UTEX 1533 | 99.8 | SEQ ID NO: 16 |
| Prototheca moriformis | UTEX 1434 | 75.9 | SEQ ID NO: 17 |
| Prototheca zopfii | UTEX 1438 | 75.7 | SEQ ID NO: 18 |
| Prototheca moriformis | UTEX 1436 | 88.9 | SEQ ID NO: 19 |

Lipid samples from a subset of the above-listed strains were analyzed for lipid profile using HPLC Results are shown below in Table 11.

TABLE 11

Diversity of lipid chains in *Prototheca* species

| Strain | C14:0 | C16:0 | C16:1 | C18:0 | C18:1 | C18:2 | C18:3 | C20:0 | C20:1 |
|---|---|---|---|---|---|---|---|---|---|
| UTEX 327 | 0 | 12.01 | 0 | 0 | 50.33 | 17.14 | 0 | 0 | 0 |
| UTEX 1441 | 1.41 | 29.44 | 0.70 | 3.05 | 57.72 | 12.37 | 0.97 | 0.33 | 0 |
| UTEX 1435 | 1.09 | 25.77 | 0 | 2.75 | 54.01 | 11.90 | 2.44 | 0 | 0 |

Oil extracted from *Prototheca moriformis* UTEX 1435 (via solvent extraction or using an expeller press was analyzed for carotenoids, chlorophyll, tocopherols, other sterols and tocotrienols. The results are summarized below in Table 12.

TABLE 12

Carotenoid, chlorophyll, tocopherol/sterols and tocotrienol analysis in oil extracted from *Prototheca moriformis* (UTEX 1435).

| | Pressed oil (mcg/ml) | Solvent extracted oil (mcg/ml) |
|---|---|---|
| cis-Lutein | 0.041 | 0.042 |
| trans-Lutein | 0.140 | 0.112 |
| trans-Zeaxanthin | 0.045 | 0.039 |
| cis-Zeaxanthin | 0.007 | 0.013 |
| t-alpha-Crytoxanthin | 0.007 | 0.010 |
| t-beta-Crytoxanthin | 0.009 | 0.010 |
| t-alpha-Carotene | 0.003 | 0.001 |
| c-alpha-Carotene | none detected | none detected |
| t-beta-Carotene | 0.010 | 0.009 |
| 9-cis-beta-Carotene | 0.004 | 0.002 |
| Lycopene | none detected | none detected |
| Total Carotenoids | 0.267 | 0.238 |
| Chlorophyll | <0.01 mg/kg | <0.01 mg/kg |

| Tocopherols and Sterols | | |
|---|---|---|
| | Pressed oil (mg/100 g) | Solvent extracted oil (mg/100 g) |
| gamma Tocopherol | 0.49 | 0.49 |
| Campesterol | 6.09 | 6.05 |
| Stigmasterol | 47.6 | 47.8 |
| Beta-sitosterol | 11.6 | 11.5 |
| Other sterols | 445 | 446 |

| Tocotrienols | | |
|---|---|---|
| | Pressed oil (mg/g) | Solvent extracted oil (mg/g) |
| alpha Tocotrienol | 0.26 | 0.26 |
| beta Tocotrienol | <0.01 | <0.01 |
| gamma Tocotrienol | 0.10 | 0.10 |
| detal Tocotrienol | <0.01 | <0.01 |
| Total Tocotrienols | 0.36 | 0.36 |

Oil extracted from *Prototheca moriformis*, from four separate lots, were refined and bleached using standard vegetable oil processing methods. Briefly, crude oil extracted from *Prototheca moriformis* was clarified in a horizontal decanter, where the solids were separated from the oil. The clarified oil was then transferred to a tank with citric acid and water and left to settle for approximately 24 hours. After 24 hours, the mixture in the tank formed 2 separate layers. The bottom layer was composed of water and gums that were then removed by decantation prior to transferring the degummed oil into a bleaching tank. The oil was then heated along with another dose of citric acid. Bleaching clay was then added to the bleaching tank and the mixture was further heated under vacuum in order to evaporate off any water that was present. The mixture was then pumped through a leaf filter in order to remove the bleaching clay. The filtered oil was then passed through a final 5 μm polishing filter and then collected for storage until use. The refined and bleached (RB) oil was then analyzed for carotenoids, chlorophyll, sterols, tocotrienols and tocopherols. The results of these analyses are summarized in Table 13 below. "Nd" denotes none detected and the sensitivity of detection is listed below:

Sensitivity of Detection

Carotenoids (mcg/g) nd=<0.003 mcg/g

Chlorophyll (mcg/g) nd=<0.03 mcg/g

Sterols (%) nd=0.25%

Tocopherols (mcg/g); nd=3 mcg/g

TABLE 13

Carotenoid, chlorophyll, sterols, tocotrienols and tocopherol analysis from refined and bleached *Prototheca moriformis* oil.

| | Lot A | Lot B | Lot C | Lot D |
|---|---|---|---|---|
| Carotenoids (mcg/g) | | | | |
| Lutein | 0.025 | 0.003 | nd | 0.039 |
| Zeaxanthin | nd | nd | nd | nd |
| cis-Lutein/Zeaxanthin | nd | nd | nd | nd |
| trans-alpha-Cryptoxanthin | nd | nd | nd | nd |
| trans-beta-Cryptoxanthin | nd | nd | nd | nd |
| trans-alpha-Carotene | nd | nd | nd | nd |
| cis-alpha-Carotene | nd | nd | nd | nd |
| trans-beta-Carotene | nd | nd | nd | nd |
| cis-beta-Carotene | nd | nd | nd | nd |
| Lycopene | nd | nd | nd | nd |
| Unidentified | 0.219 | 0.066 | 0.050 | 0.026 |
| Total Carotenoids | 0.244 | 0.069 | 0.050 | 0.065 |
| Chlorophyll (mcg/g) | | | | |
| Chlorophyll A | 0.268 | 0.136 | 0.045 | 0.166 |
| Chlorophyll B | nd | nd | nd | nd |
| Total Chlorophyll | 0.268 | 0.136 | 0.045 | 0.166 |
| Sterols (%) | | | | |
| Brassicasterol | nd | nd | nd | nd |
| Campesterol | nd | nd | nd | nd |
| Stigmasterol | nd | nd | nd | nd |
| beta-Sitosterol | nd | nd | nd | nd |
| Total Sterols | nd | nd | nd | nd |
| Tocopherols (mcg/g) | | | | |
| alpha-Tocopherol | 23.9 | 22.8 | 12.5 | 8.2 |
| beta-Tocopherol | 3.72 | nd | nd | nd |

TABLE 13-continued

Carotenoid, chlorophyll, sterols, tocotrienols and tocopherol analysis from refined and bleached *Prototheca moriformis* oil.

| | Lot A | Lot B | Lot C | Lot D |
|---|---|---|---|---|
| gamma-Tocopherol | 164 | 85.3 | 43.1 | 38.3 |
| delta-Tocopherol | 70.1 | 31.1 | 18.1 | 14.3 |
| Total Tocopherols | 262 | 139.2 | 73.7 | 60.8 |
| Tocotrienols (mcg/g) | | | | |
| alpha-Tocotrienol | 190 | 225 | 253 | 239 |
| beta-Tocotrienol | nd | nd | nd | nd |
| gamma-Tocotrienol | 47.3 | 60.4 | 54.8 | 60.9 |
| delta-Tocotrienol | 12.3 | 16.1 | 17.5 | 15.2 |
| Total Tocotrienols | 250 | 302 | 325 | 315 |

The same four lots of *Prototheca moriformis* oil was also analyzed for trace elements and the results are summarized below in Table 14.

TABLE 14

Elemental analysis of refined and bleached *Prototheca moriformis* oil.

| | Lot A | Lot B | Lot C | Lot D |
|---|---|---|---|---|
| Elemental Analysis (ppm) | | | | |
| Calcium | 0.08 | 0.07 | <0.04 | 0.07 |
| Phosphorous | <0.2 | 0.38 | <0.2 | 0.33 |
| Sodium | <0.5 | 0.55 | <0.5 | <0.5 |
| Potassium | 1.02 | 1.68 | <0.5 | 0.94 |
| Magnesium | <0.04 | <0.04 | <0.04 | 0.07 |
| Manganese | <0.05 | <0.05 | <0.05 | <0.05 |
| Iron | <0.02 | <0.02 | <0.02 | <0.02 |
| Zinc | <0.02 | <0.02 | <0.02 | <0.02 |
| Copper | <0.05 | <0.05 | <0.05 | <0.05 |
| Sulfur | 2.55 | 4.45 | 2.36 | 4.55 |
| Lead | <0.2 | <0.2 | <0.2 | <0.2 |
| Silicon | 0.37 | 0.41 | 0.26 | 0.26 |
| Nickel | <0.2 | <0.2 | <0.2 | <0.2 |
| Organic chloride | <1.0 | <1.0 | <1.0 | 2.2 |
| Inorganic chloride | <1.0 | <1.0 | <1.0 | <1.0 |
| Nitrogen | 4.4 | 7.8 | 4.2 | 6.9 |
| Lithium | <0.02 | <0.02 | <0.02 | <0.02 |
| Boron | 0.07 | 0.36 | 0.09 | 0.38 |
| Aluminum | — | <0.2 | <0.2 | <0.2 |
| Vanadium | <0.05 | <0.05 | <0.05 | <0.05 |
| Lovibond Color (°L) | | | | |
| Red | 5.0 | 4.3 | 3.2 | 5.0 |
| Yellow | 70.0 | 70.0 | 50.0 | 70.0 |
| Mono & Diglycerides by HPLC (%) | | | | |
| Diglycerides | 1.68 | 2.23 | 1.25 | 1.61 |
| Monoglycerides | 0.03 | 0.04 | 0.02 | 0.03 |
| Free fatty acids (FFA) | 1.02 | 1.72 | 0.86 | 0.83 |
| Soaps | 0 | 0 | 0 | |
| Oxidized and Polymerized Triglycerides | | | | |
| Oxidized Triglycerides (%) | 3.41 | 2.41 | 4.11 | 1.00 |
| Polymerized Triglycerides (%) | 1.19 | 0.45 | 0.66 | 0.31 |
| Peroxide Value (meq/kg) | 0.75 | 0.80 | 0.60 | 1.20 |
| p-Anisidine value (dimensionless) | 5.03 | 9.03 | 5.44 | 20.1 |
| Water and Other Impurities (%) | | | | |
| Karl Fisher Moisture | 0.8 | 0.12 | 0.07 | 0.18 |
| Total polar compounds | 5.02 | 6.28 | 4.54 | 5.23 |
| Unsaponifiable matter | 0.92 | 1.07 | 0.72 | 1.04 |
| Insoluble impurities | <0.01 | <0.01 | 0.01 | <0.01 |
| Total oil (%) | | | | |
| Neutral oil | 98.8 | 98.2 | 99.0 | 98.9 |

Example 2

General Methods for Biolistic Transformation of *Prototheca*

Seashell Gold Microcarriers 550 nanometers were prepared according to the protocol from manufacturer. Plasmid (20 μg) was mixed with 50 μl of binding buffer and 60 μl (30 mg) of S550d gold carriers and incubated in ice for 1 min. Precipitation buffer (100 μl) was added, and the mixture was incubated in ice for another 1 min After vortexing, DNA-coated particles were pelleted by spinning at 10,000 rpm in an Eppendorf 5415C microfuge for 10 seconds. The gold pellet was washed once with 500 μl of cold 100% ethanol, pelleted by brief spinning in the microfuge, and resuspended with 50 μl of ice-cold ethanol. After a brief (1-2 sec) sonication, 10 μl of DNA-coated particles were immediately transferred to the carrier membrane.

*Prototheca* strains were grown in protease medium (2 g/L yeast extract, 2.94 mM NaNO3, 0.17 mM CaCl2.2H2O, 0.3 mM MgSO4.7H2O, 0.4 mM K2HPO4, 1.28 mM KH2PO4, 0.43 mM NaCl) with 2% glucose on a gyratory shaker until it reaches a cell density of $2 \times 10^6$ cells/ml. The cells were harvested, washed once with sterile distilled water, and resuspended in 50 μl of medium. $1 \times 10^7$ cells were spread in the center third of a non-selective protease media plate. The cells were bombarded with the PDS-1000/He Biolistic Particle Delivery system (Bio-Rad). Rupture disks (1350 psi) were used, and the plates are placed 6 cm below the screen/macrocarrier assembly. The cells were allowed to recover at 25° C for 12-24 h. Upon recovery, the cells were scraped from the plates with a rubber spatula, mixed with 100 μl of medium and spread on plates containing the appropriate antibiotic selection. After 7-10 days of incubation at 25° C, colonies representing transformed cells were visible on the plates. Colonies were picked and spotted on selective (either antibiotic or carbon source) agar plates for a second round of selection.

Example 3

Transformation of *Chlorella*

Vector Construction

A BamHI-SacII fragment containing the CMV promoter, a hygromycin resistance cDNA, and a CMV 3' UTR (SEQ ID NO: 152, a subsequence of the pCAMBIA1380 vector, Cambia, Can berra, Australia) was cloned into the BamHI and SacII sites of pBluescript and is referred to herein as pHyg.

Biolistic Transformation of *Chlorella*

S550d gold carriers from Seashell Technology were prepared according to the protocol from manufacturer. Linearized pHyg plasmid (20 μg) was mixed with 50 μl of binding buffer and 60 μl (30 mg) of S550d gold carriers and incubated in ice for 1 min. Precipitation buffer (100 μl) was added, and the mixture was incubated in ice for another 1 min. After vortexing, DNA-coated particles were pelleted by spinning at 10,000 rpm in an Eppendorf 5415C microfuge for 10 seconds. The gold pellet was washed once with 500 μl of cold 100% ethanol, pelleted by brief spinning in the microfuge, and resuspended with 50 μl of ice-cold ethanol. After a brief (1-2 sec) sonication, 10 μl of DNA-coated particles were immediately transferred to the carrier membrane.

*Chlorella protothecoides* culture (Univeristy of Texas Culture Collection 250) was grown in protease medium (2 g/L yeast extract, 2.94 mM NaNO3, 0.17 mM CaCl2.2H2O, 0.3 mM MgSO4.7H2O, 0.4 mM K2HPO4, 1.28 mM KH2PO4, 0.43 mM NaCl) on a gyratory shaker under continuous light at 75 µmol photons m$^{-2}$ sec$^{-1}$ until it reached a cell density of 2×10$^6$ cells/ml. The cells were harvested, washed once with sterile distilled water, and resuspended in 50 µl of medium. 1×10$^7$ cells were spread in the center third of a non-selective protease media plate. The cells were bombarded with the PDS-1000/He Biolistic Particle Delivery system (Bio-Rad). Rupture disks (1100 and 1350 psi) were used, and the plates were placed 9 and 12 cm below the screen/macrocarrier assembly. The cells were allowed to recover at 25° C for 12-24 h. Upon recovery, the cells were scraped from the plates with a rubber spatula, mixed with 100 µl of medium and spread on hygromycin contained plates (200 µg/ml). After 7-10 days of incubation at 25° C, colonies representing transformed cells were visible on the plates from 1100 and 1350 psi rupture discs and from 9 and 12 cm distances. Colonies were picked and spotted on selective agar plates for a second round of selection.

Transformation of *Chlorella* by Electroporation

*Chlorella protothecoides* culture was grown in protease medium on a gyratory shaker under continuous light at 75 mmol photons m$^{-2}$ sec$^{-1}$ until it reached a cell density of 2×10$^6$ cells/ml. The cells were harvested, washed once with sterile distilled water, and resuspended in a tris-phosphate buffer (20 m M Tris-HCl, pH 7.0; 1 mM potassium phosphate) containing 50 mM sucrose to a density of 4×10$^8$ cells/ml. About 250 µA cell suspension (1×10$^8$ cells) was placed in a disposable electroporation cuvette of 4 mm gap. To the cell suspension, 5 µg of linearized pHyg plasmid DNA and 200 µg of carrier DNA (sheared salmon sperm DNA) was added. The electroporation cuvette was then incubated in a water bath at 16° C for 10 minutes. An electrical pulse (1100 V/cm) was then applied to the cuvette at a capacitance of 25 µF (no shunt resistor was used for the electroporation) using a Gene Pulser II (Bio-Rad Labs, Hercules, Calif.) electroporation apparatus. The cuvette was then incubated at room temperature for 5 minutes, following which the cell suspension was transferred to 50 ml of protease media, and shaken on a gyratory shaker for 2 days. Following recovery, the cells were harvested by centrifugation at low speed, resuspended in protease media, and plated at low density on plates supplemented with 200 µg/ml hygromycin. The plates were incubated under continuous light at 75 mmol photons m$^{-2}$ sec$^{-1}$. Transformants appeared as colonies in 1-2 weeks. Colonies were picked and spotted on selective agar plates for a second round of selection.

Genotyping

A subset of colonies that survived a second round of selection were cultured in small volume and harvested. Pellets of approximately 5-10 uL volume were resuspended in 50 uL of 10 mM NaEDTA by vortexing and then incubated at 100° C for 10. The tubes were then vortexed briefly and sonicated for 10 seconds, then centrifuged at 12,000×g for 1 minute. 2 uL of supernatant as template was used in a 50 uL PCR reaction. Primers used for genotyping were SEQ ID NO: 153 and SEQ ID NO: 154. PCR conditions were as follows: 95° C 5 mM×1 cycle; 95° C 30 sec –58° C 30 sec –72° C 1 mM 30 sec×35 cycles; 72° C 10 min×1 cycle. The expected 992 bp fragment was found in 6 of 10 colonies from the biolistic method and from a single electroporation colony. A lower sized, nonspecific band was present in all lanes. To confirm the identity of the amplified 992 bp fragment, two biolistic bands and the electroporation band were excised from the gel and individually sequenced. The sequence of all three bands corresponded to the expected 992 bp fragment. (DNA ladder: Bionexus® All Purpose Hi-Lo® DNA ladder catalog #BN2050).

Example 4

Algal-Derived Promoters and Genes for Use in Microalgae

A. 5'UTR and Promoter Sequences from *Chlorella protothecoides*

A cDNA library was generated from mixotrophically grown *Chlorella* protothecoides (UTEX 250) using standard techniques. Based upon the cDNA sequences, primers were designed in certain known housekeeping genes to "walk" upstream of the coding regions using Seegene's DNA Walking kit (Rockville, Md.). Sequences isolated include an actin (SEQ ID NO: 155) and elongation factor-1a (EF1a) (SEQ ID NO: 156) promoter/UTR, both of which contain introns (as shown in the lower case) and exons (upper case italicized) and the predicted start site (in bold) and two beta-tubulin promoter/UTR elements: Isoform A (SEQ ID NO: 157) and Isoform B (SEQ ID NO: 158).

B. Lipid Biosynthesis Enzyme and Plastid Targeting Sequences from *C protothecoides*

From the cDNA library described above, three cDNAs encoding proteins functional in lipid metabolism in *Chlorella protothecoides* (UTEX 250) were cloned using the same methods as described above. The nucleotide and amino acid sequences for an acyl ACP desaturase (SEQ ID NOs: 159 and 160) and two geranyl geranyl diphosphate synthases (SEQ ID NOs: 161-164) are included in the Sequence Listing below. Additionally, three cDNAs with putative signal sequences targeting to the plastid were also cloned. The nucleotide and amino acid sequences for a glyceraldehyde-3-phosphate dehydrogenase (SEQ ID NOs: 165 and 166), an oxygen evolving complex protein OEE33 (SEQ ID NOs: 167 and 168) and a Clp protease (SEQ ID NOs: 169 and 170) are included in the Sequence Listing below. The putative plastid targeting sequence has been underlined in both the nucleotide and amino acid sequence. The plastid targeting sequences can be used to target the producs of transgenes to the plastid of microbes, such as lipid modification enzymes.

Example 5

Genetic Engineering of *Chlorella protothecoides* to Express an Exogenous Sucrose Invertase Strains and Media: *Chlorella protothecoides* (UTEX 250) was obtained from the Culture Collection of Alga at the University of Texas (Austin, Tex., USA). The stock cultures were maintained on modified Protease medium. Modified Protease medium consists of 0.25 g NaNO$_3$, 0.09 g K$_2$HPO$_4$, 0.175 g KH$_2$PO$_4$ 0.025 g, 0.025 g CaCl$_2$.2H$_2$O, 0.075 g MgSO$_4$.7H$_2$O, and 2 g yeast extract per liter (g/L).

Plasmid Construction: To express the secreted form of invertase in *Chlorella protothecoides*, a *Saccharomyces cerevisiae* SUC2 gene was placed under the control of three different promoters: Cauliflower mosaic virus 35S promoter (CMV), *Chlorella* virus promoter (NC-1A), and *Chlorella* HUP1 promoter. A yeast SUC2 gene was synthesized to accommodate codon usage optimized for *C protothecoides* and includes a signal sequence required for directing extracellular secretion of invertase. Each construct was built in pBluescript KS+, and EcoRI/AscI, AscI/XhoI, and XhoI/BamHI sites were introduced to each promoter, invertase gene, and CMV 3'UTR, respectively, by PCR amplification using specific primers. Purified PCR products were cloned sequentially.

Transformation of *Chlorella protothecoides*: A *Chlorella protothecoides* culture was grown in modified Protease medium on a gyratory shaker under continuous light at 75 µmol photons m$^{-2}$ sec$^{-1}$ till it reached a cell density of 6×10$^6$ cells/ml.

For biolistic transformation, S550d gold carriers from Seashell Technology were prepared according to the protocol from the manufacturer. Briefly, a linearized construct (20 µg) by BsaI was mixed with 50 µl of binding buffer and 60 µl (3 mg) of S550d gold carriers and incubated in ice for 1 mM Precipitation buffer (100 µl) was added, and the mixture was incubated in ice for another 1 min. After mild vortexing, DNA-coated particles were pelleted by spinning at 10,000 rpm in an Eppendorf microfuge for 10 seconds. The gold pellet was washed once with 500 µl of cold 100% ethanol, pelleted by brief spinning in the microfuge, and resuspended with 50 µl of ice-cold ethanol. After a brief (1-2 sec) sonication, 10 µl of DNA-coated particles were immediately transferred to the carrier membrane. The cells were harvested, washed once with sterile distilled water, resuspended in 50 µl of medium (1×10$^7$ cells), and were spread in the center third of a non-selective Proteous plate. The cells were bombarded with the PDS-1000/He Biolistic Particle Delivery system (Bio-Rad). Rupture disks (1100 and 1350 psi) were used, and the plates were placed 9-12 cm below the screen/macrocarrier assembly. The cells were allowed to recover at 25° C for 12-24 hours. Upon recovery, the cells were scraped from the plates with a rubber spatula, mixed with 100 µl of medium and spread on modified Protease plates with 1% sucrose. After 7-10 days of incubation at 25° C in the dark, colonies representing transformed cells were visible on the plates.

For transformation with electroporation, cells were harvested, washed once with sterile distilled water, and resuspended in a Tris-phosphate buffer (20 mM Tris-HCl, pH 7.0; 1 mM potassium phosphate) containing 50 mM sucrose to a density of 4×10$^8$ cells/ml. About 250 µl cell suspension (1×10$^8$ cells) was placed in a disposable electroporation cuvette of 4 mm gap. To the cell suspension, 5 µg of linearized plasmid DNA and 200 µg of carrier DNA (sheared salmon sperm DNA) were added. The electroporation cuvette was then incubated in an ice water bath at 16° C for 10 min. An electrical pulse (1100 V/cm) was then applied to the cuvette at a capacitance of 25 µF (no shunt resistor was used for the electroporation) using a Gene Pulser II (Bio-Rad Labs, Hercules, Calif.) electroporation apparatus. The cuvette was then incubated at room temperature for 5 minutes, following which the cell suspension was transferred to 50 ml of modified Protease media, and shaken on a gyratory shaker for 2 days. Following recovery, the cells were harvested at low speed (4000 rpm), resuspended in modified Protease media, and plated out at low density on modified Protease plates with 1% sucrose. After 7-10 days of incubation at 25° C in the dark, colonies representing transformed cells were visible on the plates.

Screening Transformants and Genotyping: The colonies were picked from dark grown-modified Protease plates with 1% sucrose, and approximately the same amount of cells were transferred to 24 well-plates containing 1 ml of modified Protease liquid media with 1% sucrose. The cultures were kept in dark and agitated by orbital shaker from Labnet (Berkshire, UK) at 430 rpm for 5 days.

To verify the presence of the invertase gene introduced in *Chlorella* transformants, DNA of each transformant was isolated and amplified with a set of gene-specific primers (CMV construct: forward primer (CAACCACGTCTTCAAAG-CAA) (SEQ ID NO: 153)/reverse primer (TCCGGTGTGT-TGTAAGTCCA) (SEQ ID NO: 171), CV constructs: forward primer (TTGTCGGAATGTCATATCAA) (SEQ ID NO: 172)/reverse primer (TCCGGTGTGTTGTAAGTCCA) (SEQ ID NO: 171), and HUP1 construct: forward primer (AACGCCTTTGTACAACTGCA) (SEQ ID NO: 173)/reverse primer (TCCGGTGTGTTGTAAGTCCA) (SEQ ID NO: 171)). For quick DNA isolation, a volume of cells (approximately 5-10 uL in size) were resuspended in 50 uL of 10 mM Na-EDTA. The cell suspension was incubated at 100° C for 10 mM and sonicated for 10 sec. After centrifugation at 12000 g for 1 mM, 3 uL of supernatant was used for the PCR reaction. PCR amplification was performed in the DNA thermal cycler (Perkin-Elmer GeneAmp 9600). The reaction mixture (50 uL) contained 3 uL extracted DNA, 100 µmol each of the respective primers described above, 200 uM dNTP, 0.5 units of Taq DNA polymerase (NEB), and Taq DNA polymerase buffer according to the manufacturer's instructions. Denaturation of DNA was carried out at 95° C for 5 mM for the first cycle, and then for 30 sec. Primer annealing and extension reactions were carried out at 58° C for 30 sec and 72° C for 1 min respectively. The PCR products were then visualized on 1% agarose gels stained with ethidium bromide.

Growth in Liquid Culture: After five days growth in darkness, the genotype-positive transformants showed growth on minimal liquid Protease media+1% sucrose in darkness, while wild-type cells showed no growth in the same media in darkness.

Example 6

Transformation of Algal Strains with a Secreted Invertase Derived from *S. cerevisiae*

Secreted Invertase: A gene encoding a secreted sucrose invertase (Gen Bank Accession no. NP_012104 from *Saccharomyces cerevisiae*) was synthesized de-novo as a 1599 bp Asc I-Xho fragment that was subsequently sub-cloned into a pUC19 derivative possessing the Cauliflower Mosaic Virus 35s promoter and 3' UTR as EcoR I/Asc I and Xho/Sac I cassettes, respectively.

Growth of Algal Cells: Media used in these experiments was liquid base media (2 g/L yeast extract, 2.94 mM NaNO$_3$, 0.17 mM CaCl$_2$.2H$_2$O, 0.3 mM MgSO$_4$.7H$_2$O, 0.4 mM K$_2$HPO$_4$, 1.28 mM KH$_2$PO$_4$, 0.43 mM NaCl) and solid base media (+1.5% agarose) containing fixed carbon in the form of sucrose or glucose (as designated) at 1% final concentration. The strains used in this experiment did not grow in the dark on base media in the absence of an additional fixed carbon source. Species were struck out on plates, and grown in the dark at 28° C Single colonies were picked and used to inoculate 500 mL of liquid base media containing 1% glucose and allowed to grow in the dark until mid-log phase, measuring cell counts each day. Each of the following strains had been previously tested for growth on sucrose in the dark as a sole carbon source and exhibited no growth, and were thus chosen for transformation with a secreted invertase: (1) *Chlorella protothecoides* (UTEX 31); (2) *Chlorella minutissima* (UTEX 2341); and (3) *Chlorella emersonii* (CCAP 211/15).

Transformation of Algal Cells via Particle Bombardment: Sufficient culture was centrifuged to give approximately 1–5×10$^8$ total cells. The resulting pellet was washed with base media with no added fixed carbon source. Cells were centrifuged again and the pellet was resuspended in a volume of base media sufficient to give 5×10$^7$ to 2×10$^8$ cells/ml. 250-1000 µl of cells were then plated on solid base media supplemented with 1% sucrose and allowed to dry onto the plate in a sterile hood. Plasmid DNA was precipitated onto gold particles according to the manufacturer's recommendations (Seashell Technology, La Jolla, Calif.). Transformations were carried out using a BioRad PDS He-1000 particle delivery system using 1350 psi rupture disks with the macrocarrier assembly set at 9 cm from the rupture disk holder. Following transformations, plates were incubated in the dark at 28° C All strains generated multiple transformant colonies. Control plates transformed with no invertase insert, but otherwise prepared in an identical fashion, contained no colonies.

Analysis of *Chlorella prototheocoides* transformants: Genomic DNA was extracted from *Chlorella prototheocoides* wild type cells and transformant colonies as follows: Cells were resuspended in 100 ul extraction buffer (87.5 mM Tris Cl, pH 8.0, 50 mM NaCl, 5 mM EDTA, pH 8.0, 0.25% SDS) and incubated at 60° C, with occasional mixing via inversion, for 30 minutes. For PCR, samples were diluted 1:100 in 20 mM Tris Cl, pH 8.0.

Genotyping was done on genomic DNA extracted from WT, the transformants and plasmid DNA. The samples were genotyped for the marker gene. Primers 2383 (5' CTGAC-CCGACCTATGGGAGCGCTCTTGGC 3') (SEQ ID NO: 174) and 2279 (5' CTTGACTTCCCTCACCTG-GAATTTGTCG 3') (SEQ ID NO: 175) were used in this genotyping PCR. The PCR profile used was as follows: 94° C denaturation for 5 mM; 35 cycles of 94° C—30 sec, 60° C—30 sec, 72° C—3 mM; 72° C—5 mM A band of identical size was amplified from the positive controls (plasmid) and two transformants of *Chlorella prototheocoides* (UTEX 31).

Analysis of *Chlorella minutissima* and *Chlorella emersonii* transformants: Genomic DNA was extracted from *Chlorella* WT and the tranformants as follows: Cells were resuspended in 100 ul extraction buffer (87.5 mM Tris Cl, pH 8.0, 50 mM NaCl, 5 mM EDTA, pH 8.0, 0.25% SDS) and incubated at 60° C, with occasional mixing via inversion, for 30 minutes. For PCR, samples were diluted 1:100 in 20 mM Tris Cl, pH 8.0. Genotyping was done on genomic DNA extracted from WT, the transformants and plasmid DNA. The samples were genotyped for the marker gene. Primers 2336 (5' GTG-GCCATATGGACTTACAA 3') (SEQ ID NO: 176) and 2279 (5' CTTGACTTCCCTCACCTGGAATTTGTCG 3') (SEQ ID NO: 175) were designated primer set 2 (1215 bp expected product), while primers 2465 (5' CAAGGGCTGGATGAAT-GACCCCAATGGACTGTGGTACGACG 3') (SEQ ID NO: 177) and 2470 (5' CACCCGTCGTCATGTTCACGGAGC-CCAGTGCG 3') (SEQ ID NO: 178) were designated primer set 4 (1442 bp expected product). The PCR profile used was as follows: 94° C denaturation for 2 mM; 29 cycles of 94° C-30 sec, 60° C-30 sec, 72° C-1 min, 30 sec; 72° C-5 min. A plasmid control containing the secreted invertase was used as a PCR control.

The sequence of the invertase construct corresponds to SEQ ID NO: 8.

Example 7

Homologous Recombination in *Protheca* Species

Homologous recombination of transgenes has several advantages. First, the introduction of transgenes without homologous recombination can be unpredictable because there is no control over the number of copies of the plasmid that gets introduced into the cell. Also, the introduction of transgenes without homologous recombination can be unstable because the plasmid may remain episomal and is lost over subsequent cell divisions. Another advantage of homologous recombination is the ability to "knock-out" gene targets, introduce epitope tags, switch promoters of endogenous genes and otherwise alter gene targets (e.g., the introduction of point mutations).

Two vectors were constructed using a specific region of the *Prototheca moriformis* (UTEX 1435) genome, designated KE858. KE858 is a 1.3 kb, genomic fragment that encompasses part of the coding region for a protein that shares homology with the transfer RNA (tRNA) family of proteins. Southern blots have shown that the KE858 sequence is present in a single copy in the *Prototheca moriformis* (UTEX 1435) genome. The first type of vector that was constructed, designated SZ725 (SEQ ID NO: 179), consisted of the entire 1.3 kb KE858 fragment cloned into a pUC19 vector backbone that also contains the optimized yeast invertase (suc2) gene. The KE858 fragment contains a unique SnaB 1 site that does not occur anywhere else in the targeting construct. The second type of vector that was constructed, designated SZ726 (SEQ ID NO: 180), consisted of the KE858 sequence that had been disrupted by the insertion of the yeast invertase gene (suc2) at the SnaB 1 site within the KE858 genomic sequence. The entire DNA fragment containing the KE858 sequences flanking the yeast invertase gene can be excised from the vector backbone by digestion with EcoRI, which cuts at either end of the KE858 region.

Both vectors were used to direct homologous recombination of the yeast invertase gene (suc2) into the corresponding KE858 region of the *Prototheca moriformis* (UTEX 1435) genome. The linear DNA ends homologous to the genomic region that was being targeted for homologous recombination were exposed by digesting the vector construct SZ725 with SnaB1 and vector construct SZ726 with EcoRI. The digested vector constructs were then introduced into *Prototheca moriformis* cultures using methods described above. Transformants from each vector construct were then selected using sucrose plates. Ten independent, clonally pure transformants from each vector transformation were analyzed for successful recombination of the yeast invertase gene into the desired genomic location (using Southern blots) and for transgene stability.

Southern blot analysis of the SZ725 transformants showed that 4 out of the 10 transformants picked for analysis contained the predicted recombinant bands, indicating that a single crossover event had occurred between the KE858 sequences on the vector and the KE858 sequences in the genome. In contrast, all ten of the SZ726 transformants contained the predicted recombinant bands, indicating that double crossover events had occurred between the EcoRI fragment of pSZ726 carrying KE858 sequence flanking the yeast invertase transgene and the corresponding KE858 region of the genome.

Sucrose invertase expression and transgene stability were assessed by growing the transformants for over 15 generations in the absence of selection. The four SZ725 transformants and the ten SZ276 transformants that were positive for the transgene by Southern blotting were selected and 48 single colonies from each of the transformants were grown serially: first without selection in glucose containing media and then with selection in media containing sucrose as the sole carbon source. All ten SZ276 transformants (100%) retained their ability to grow on sucrose after 15 generations, whereas about 97% of the SZ725 transformants retained their ability to grow on sucrose after 15 generations. Transgenes introduced by a double crossover event (SZ726 vector) have extremely high stability over generation doublings. In contrast, transgenes introduced by a single cross over event (SZ725 vector) can result in some instability over generation doublings because is tandem copies of the transgenes were introduced, the repeated homologous regions flanking the transgenes may recombine and excise the transgenic DNA located between them.

These experiments demonstrate the successful use of homologous recombination to generate *Prototheca* transformants containing a heterologous sucrose invertase gene that is stably integrated into the nuclear chromosomes of the organism. The success of the homologous recombination enables other genomic alterations in *Prototheca*, including gene deletions, point mutations and epitope tagging a desired gene product. These experiments also demonstrate the first documented system for homologous recombination in the nuclear genome of a eukaryotic microalgae.

Use of Homologous Recombination to Knock-out an Endogenous *Prototheca moriformis* gene: In a *Prototheca moriformis* cDNA/genomic screen, like that described above in Example 4, an endogenous stearoyl ACP desaturase (SAPD) cDNA was identified. Stearoyl ACP desaturase enzymes are part of the lipid synthesis pathway and they function to introduce double bonds into the fatty acyl chains. In some cases, it may be advantages to knock-out or reduce the expression of lipid pathway enzymes in order to alter a fatty acid profile. A homologous recombination construct was created to assess whether the expression of an endogenous stearoyl ACP desaturase enzyme can be reduced (or knocked out) and if a corresponding reduction in unsaturated fatty acids can be observed in the lipid profile of the host cell. An approximately 1.5 kb coding sequence of a stearoyl ACP desaturase gene from *Prototheca moriformis* (UTEX 1435) was identified and cloned (SEQ ID NO: 181). The homologous recombination construct was constructed using 0.5 kb of the SAPD coding sequence at the 5' end (5' targeting site), followed by the *Chlamydomonas reinhardtii* β-tublin promoter driving a codon-optimized yeast sucrose invertase suc2 gene with the *Chlorella vulgaris* 3'UTR. The rest (~1 kb) of the *Prototheca moriformis* SAPD coding sequence was then inserted after the *C vulgaris* 3'UTR to make up the 3' targeting site. The sequence for this homologous recombination cassette is listed in SEQ ID NO: 182. As shown above, the success-rate for integration of the homologous recombination cassette into the nuclear genome can be increased by linearizing the cassette before transforming the microalgae, leaving exposed ends. The homologous recombination cassette targeting an endogenous SAPD enzyme in *Prototheca moriformis* is linearized and then transformed into the host cell (*Prototheca moriformis*, UTEX 1435). A successful integration will eliminate the endogenous SAPD enzyme coding region from the host genome via a double reciprocal recombination event, while expression of the newly inserted suc2 gene will be regulated by the *C reinhardtii* β-*tubulin promoter. The resulting clones can be screened using plates/media containing sucrose as the sole carbon source. Clones containing a successful integration of the homologous recombination cassette will have the ability to grow on sucrose as the sole carbon source and changes in overall saturation of the fatty acids in the lipid profile will serve as a secondary confirmation factor. Additionally, Southern blotting assays using a probe specific for the yeast sucrose invertase suc2 gene and RT-PCR can also confirm the presence and expression of the invertase gene in positive clones. As an alternative, the same construct without the β-tubulin promoter can be used to excise the endogenous SAPD enzyme coding region. In this case, the newly inserted yeast sucrose invertase suc2 gene will be regulated by the endogenous SAPD promoter/5'UTR.

Example 8

Expression of Various Thioesterases in *Prototheca*

Methods and effects of expressing a heterologous thioesterase gene in *Prototheca* species have been previously described in PCT Application No. PCT/US2009/66142, hereby incorporated by reference. The effect of other thioesterase genes/gene products from higher plants species was further investigated. These thioesterases include thioesterases from the following higher plants:

| Species | GenBank Accession No. | Specificity | SEQ ID NO: |
|---|---|---|---|
| *Cinnamomum camphora* | Q39473 | C14 | SEQ ID NOs: 30-31 |
| *Umbellularia californica* | Q41635 | C10-C12 | SEQ ID NOs: 34-35 |
| *Cuphea hookeriana* | AAC49269 | C8-C10 | SEQ ID NOs: 32-33 |
| *Cuphea palustris* | AAC49179 | C8 | SEQ ID NOs: 36-37 |
| *Cuphea lanceolata* | CAB60830 | C10 | SEQ ID NOs: 38-39 |
| *Iris germanica* | AAG43858.1 | C14 | SEQ ID NOs: 40-41 |
| *Myristica fragrans* | AAB717291.1 | C14 | SEQ ID NOs: 42-43 |
| *Cuphea palustris* | AAC49180 | C14 | SEQ ID NOs: 44-45 |
| *Ulmus americana* | AAB71731 | broad | SEQ ID NOs: 46-47 |

In all cases, each of the above thioesterase constructs was transformed in to *Prototheca moriformis* (UTEX 1435) using biolistic particle bombardment. Other transformation methods including homologous recombination as disclosed in PCT Application No. PCT/US2009/66142, would also be suitable for heterologous expression of genes of interest. Transformation of *Prototheca moriformis* (UTEX 1435) with each of the above thioesterase constructs was performed using the methods described in Example 2. Each of the constructs contained a NeoR gene and selection for positive clones was carried out using 100 µg/ml G418. All coding regions were codon optimized to reflect the codon bias inherent in *Prototheca moriformis* UTEX 1435 (see Table 2) nuclear genes. Both amino acid sequences and the cDNA sequences for the construct used are listed in the sequence identity listing. The transit peptide for each of the higher plant thioesterase was replaced with an algal codon optimized transit peptide from *Prototheca moriformis* delta 12 fatty acid desaturase (SEQ ID NO: 48)) or from *Chlorella protothecoides* stearoyl ACP desaturase (SEQ ID NO: 49). All thioesterase constructs were driven by the *Chlamydomanas reinhardtii* beta-tubulin promoter/5'UTR. Growth and lipid production of selected positive clones were compared to wildtype (untransformed) *Prototheca moriformis* (UTEX 1435). Wildtype and selected positive clones were grown on 2% glucose G418 plates. Lipid profiles analysis on selected positive clones for each construct is summarized below (expressed in Area %) in Table 15.

TABLE 15

Lipid profiles of *Prototheca moriformis* expressing various heterologous thioesterases.

| | | | | | | Thioesterase | | | | |
|---|---|---|---|---|---|---|---|---|---|---|
| Fatty Acid | UTEX 1435 wt | *U. californica* | *C. camphora* | *I. germanica* | *M. fragrans* | *C. palustris* C8:0 | *C. hookeriana* | *C. lanceolata* | *C. palustris* C14:0 | *U. americana* |
| C8:0 | 0 | 0 | 0 | 0 | | 3.1 | 1.8 | 0 | 0 | .09 |
| C10:0 | 0.02 | .07 | .02 | .01 | .09 | .56 | 6.85 | 1.91 | .01 | 2.85 |
| C12:0 | 0.05 | 14 | 1.82 | .09 | .05 | .25 | .2 | .29 | .06 | .74 |

TABLE 15-continued

Lipid profiles of *Prototheca moriformis* expressing various heterologous thioesterases.

| | | | | | Thioesterase | | | | |
|---|---|---|---|---|---|---|---|---|---|
| Fatty Acid | UTEX 1435 wt | *U. californica* | *C. camphora* | *I. germanica* | *M. fragrans* | *C. palustris* C8:0 | *C. hookeriana* | *C. lanceolata* | *C. palustris* C14:0 | *U. americana* |
| C14:0 | 1.65 | 3 | 17.3 | 2.59 | 5.31 | 1.45 | 1.8 | 1.83 | 2.87 | 10.45 |
| C16:0 | 28.0 | 21.4 | 24.3 | 26.52 | 31.08 | 22.84 | 23.9 | 25.55 | 27.23 | 33.3 |
| C18:0 | 2.9 | 2.9 | 2.7 | 3.11 | 2.71 | 3.24 | 2.8 | 3.26 | 3.62 | 3.47 |
| C18:1 | 53.8 | 45.2 | 41.3 | 49.96 | 39.77 | 56.62 | 49.8 | 55.43 | 51.04 | 38.71 |
| C18:2 | 10.95 | 10 | 9.7 | 11.86 | 14.17 | 8.24 | 9.7 | 8.17 | 10.81 | 7.38 |
| C18:3 α | 0.8 | .86 | .8 | .40 | .64 | .61 | .9 | .58 | .97 | .52 |
| Total saturates (area %) | 32.62 | 44.97 | 46.14 | 32.32 | 39.24 | 31.44 | 37.35 | 32.84 | 33.79 | 50.9 |

The results show that all of the thioesterases expressed impacted fatty acid profiles to some level. Looking at the "Total saturates" row, the degree of saturation was profoundly impacted by the expression of several of the thioesterases, including those from *U. californica, C camphora*, and most notably, *U. americana*. These changes in the percentage of total saturates were unexpected in that the heterologous expression of thioesterases from higher plants can apparently impact more than just lipid chain lengths; it can also impact other attributes of lipid profiles produced by microalgae, namely the degree of saturation of the fatty acids.

Selected clones transformed with *C palustris* C8 thioesterase, *C. hookeriana* thioesterase, *U. californica* and *C camphora* thioesterase were further grown in varying amounts of G418 (from 25 mg/L to 50 mg/L) and at varying temperatures (from 22° C to 25° C) and the lipid profile was determined for these clones. Table 16 summarizes the lipid profile (in Area %) of representative clones containing each thioesterase. A second construct containing the *U. americana* thioesterase was constructed and transformed into *Prototheca moriformis* (UTEX 1435) using the biolistic methods described above. This second construct was introduced into the cell via homologous recombination. Methods of homologous recombination in *Prototheca* species were described previously in PCT Application No. PCT/US2009/66142. The homologous DNA that was used was from genomic DNA sequence of 6S rRNA from *Prototheca moriformis* UTEX 1435. The selection agent was the ability to grow on sucrose, using a codon optimized suc2 gene from *S. cereveisiae* driven by the *C reinhardtii* beta tubulin promoter. The native *U. americana* transit peptide was replaced by the *Chlorella protothecoides* (UTEX 250) stearoyl ACP desaturase transit peptide. The cDNA of this construct is listed in the Sequence Listing as SEQ ID NO: 50. Selection of positive clones was performed on 2% sucrose plates and the resulting cultures for lipid profile determination was also grown on 2% sucrose containing medium. A representative lipid profile for this *Prototheca moriformis* strain containing a homologously recombined heterologous *U. americana* thioesterase is summarized in Table 16.

TABLE 16

Lipid profiles of *Prototheca moriformis* strains containing heterologous thioesterase genes.

| | *C. palustris* C8 | *C. hookeriana* | *C. camphora* | *U. americana* 2 |
|---|---|---|---|---|
| C8:0 | 12.28 | 2.37 | 0 | 0 |
| C10:0 | 2.17 | 12.09 | 0.02 | 4.69 |
| C12:0 | 0.34 | 0.33 | 3.81 | 1.02 |

TABLE 16-continued

Lipid profiles of *Prototheca moriformis* strains containing heterologous thioesterase genes.

| | *C. palustris* C8 | *C. hookeriana* | *C. camphora* | *U. americana* 2 |
|---|---|---|---|---|
| C14:0 | 1.59 | 2.08 | 32.73 | 16.21 |
| C16:0 | 15.91 | 20.07 | 24.03 | 38.39 |
| C18:0 | 1.59 | 1.57 | 1.21 | 2.83 |
| C18:1 | 50.64 | 41.80 | 18.64 | 27.22 |
| C18:2 | 13.02 | 16.37 | 16.57 | 7.65 |
| C18:3 α | 1.52 | 1.75 | 1.66 | 0.74 |
| Total saturates | 33.88 | 38.51 | 61.80 | 63.14 |

As with the clones described above, all transformants containing a heterologous thioesterase gene showed impacted fatty acid profiles to some level, and the total percent of saturated fatty acids were also changed, as compared to wild-type (untransformed) *Prototheca moriformis*. The *Prototheca moriformis* containing the *U. americana* thioesterase introduced by homologous recombination had the greatest increase in total saturates.

Additionally, transgenic clones containing the exogenous *C. hookeriana, C camphora, U. californica* or *U. americana* thioesterase were assessed for novel lipid profiles. The *C. hookeriana* thioesterase containing clone achieved the following lipid profile when grown in 2% glucose, 25 mg/ml G418 at 22° C: 5.10% C8:0; 18.28% C10:0; 0.41% C12:0; 1.76% C14:0; 16.31% C16:0; 1.40% C18:0; 40.49% C18:1; and 13.16% C18:2. The *C. camphora* thioesterase-containing clone (also containing an exogenous sucrose invertase) achieved the following lipid profile when grown in 2% sucrose at 25° C: 0.04% C10:0; 6.01% C12:0; 35.98% C14:0; 19.42 C16:0; 1.48% C18:0; 25.44% C18:1; and 9.34% C18:2. The *U. calfornica* thioesterase containing clone achieved the following lipid profile when grown in 2% glucose, 25-100 mg/ml G418 at 22° C: 0% C8:0; 0.11% C10:0; 34.01% C12:0; 5.75% C14:0; 14.02% C16:0; 1.10% C18:0; 28.93% C18:1; and 13.01% C18:2. The *U. americana* thioesterase containing clone achieved the following lipid profile when grown in 2% glucose at 28° C: 1.54% C10:0; 0.43% C12:0; 7.56% C14:0; 39.45% C16:0; 2.49% C18:0; 38.49% C18:1; and 7.88% C18:2.

Example 9

Transformation of *Prototheca* with Multiple Exogenous Heterologous Thioesterase Genes Microalgae strain *Prototheca moriformis* (UTEX 1435) was transformed using the above disclosed methods to express multiple thioesterases in a single clone. The expression of multiple thioesterases in a single clone allows the microaglae to produce oils with fatty acid profiles completely different from those elaborated when any single thioesterase is expressed alone (as demonstrated in the preceding Examples). Prototheca moriformis (UTEX 1435) was first transformed with the Cinnamomum camphora thioesterase (a C14 preferring thioesterase) along with a sucrose invertase gene, the suc2 from S. cerevisiae (selection was the ability to grow on sucrose) using homologous recombination. The DNA used for this homologous recombination construct is from the KE858 region of Prototheca moriformis genomic DNA as described in the Section III above. The relevant portion of this construct is listed in the Sequence Listing as SEQ ID NO: 51. Positive clones were screened on sucrose-containing plates. A positive clone was then re-transformed with one of three cassettes, each encoding resistance to the antibiotic G418 as well as an additional thioesterase: (1) thioesterase gene from Cuphea hookeriana (C8-10 preferring), SEQ ID NO: 52; (2) thioesterase gene from Umbellularia californica (C12 preferring), SEQ ID NO: 53; or thioesterase from Ulmus americana (broad; C10-C16 preferring), SEQ ID NO: 54. Included in the Sequence Listing is the sequence of the relevant portion of each construct. Clones expressing both thioesterase genes were screened on sucrose containing medium with 50 μg/ml G418. Positive clones were selected and growth and lipid profile were assayed. Table 17 summarizes the lipid profile of representative positive clones (expressed in Area %).

of multiple thioesterases results in altered fatty acid profiles that differ significantly not only from the wild type strain, but also from the fatty acid profile obtained by the expression of any one of the individual thioesterases. The expression of multiple thioesterases with overlapping chain length specificity can result in cumulative increases in those specific fatty acids.

The expression of heterologous thioesterases (either alone or in combination) in Prototheca moriformis not only alters the fatty acid/lipid profiles in the host strain, but when compared to oils currently available from a variety of seed crops (Table 5), these profiles are of truly unique oils found in no other currently available system. Not only do the transgenic strains show significant differences from the untransformed wildtype strain, they have remarkably different profiles from any of the commercial oils that are shown in Table 5. As an example, both coconut and palm kernel oils have levels of C8-C10 fatty acids ranging from 5.5-17%. Transgenic strain expressing the C palustris C8-preferring thioesterase or the C. hookeriana C10-preferring thioesterase accumulates anywhere from 3.66 to 8.65%, respectively. These C8-C10 fatty acid levels are similar to coconut oil and palm kernel, however, the transgenic algal strains lack the significantly higher C12:0 fatty acids, and they have extremely high C16:0 (23% in transgenics versus 11-16% in coconut or palm kernel oil, respectively and/or 18:1 (50-57% in transgenics versus 8-19% in coconut or palm kernel oil, respectively.

TABLE 17

Lipid profiles of Prototheca moriformis transformed with multiple thioesterases.

| Fatty Acid | UTEX 1435 | UTEX 1435 + C. camphora TE | UTEX 1435 + C. camphora TE genetic background | | |
|---|---|---|---|---|---|
| | | | +C. hookeriana TE | +U. californica TE | +U. americana TE |
| C8:0 | 0 | 0 | 0.19 | 0 | 0.06 |
| C10:0 | 0.02 | 0.02 | 2.16 | 0.07 | 1.87 |
| C12:0 | 0.05 | 0.66 | 0.53 | 13.55 | 1.61 |
| C14:0 | 1.65 | 10.52 | 7.64 | 8.0 | 14.58 |
| C16:0 | 28.0 | 22.56 | 22.31 | 19.98 | 29.53 |
| C18:0 | 2.9 | 6.67 | 3.23 | 2.24 | 2.93 |
| C18:1 | 53.8 | 47.78 | 48.54 | 42.55 | 37.3 |
| C18:2 | 10.95 | 12.3 | 11.76 | 10.13 | 8.9 |
| C18:3 α | 0.8 | 0.93 | 0.91 | 0.91 | 0.76 |
| Total saturates (Area %) | 32.62 | 40.43 | 36.06 | 43.84 | 50.58 |

Additionally, a double thioesterase clone with C camphora and U. californica thioesterases was grown in 2% sucrose containing medium with 50 mg/L G418 at 22° C. The fatty acid profile obtained from this strain under these growth conditions was: C8:0 (0); C10:0 (0.10); C12:0 (31.03); C14:0 (7.47); C16:0 (15.20); C18:0 (0.90); C18:1 (30.60); C18:2 (12.44); and C18:3a (1.38), with a total saturates of 54.7.

Double thioesterase clones with two homologous recombination constructs (one targeting the 6S region and the other targeting the KE858 region) containing the C camphora thioesterase were produced. A positive representative clone had a fatty acid profile of: 0% C8:0; 0.06% C10:0; 5.91% C12:0; 43.27% C14:0; 19.63% C16:0; 0.87% C18:0; 13.96% C18:1; and 13.78% C18:2, with a total saturates at 69.74%. This clone had a C12-C14 level at over 49%, which is over 37 times the C12-C14 level in wildtype cells.

The above data shows that multiple thioesterases can be successfully co-expressed in microalgae. The co-expression Example 10

Identification of Endogenous Nitrogen-Dependent Prototheca Promoters

A. Identification and Characterization of Endogenous Nitrogen-Dependent promoters.

A cDNA library was generated from Prototheca moriformis (UTEX 1435) using standard techniques. The Prototheca moriformis cells were grown for 48 hours under nitrogen replete conditions. Then a 5% innoculum (v/v) was then transferred to low nitrogen and the cells were harvested every 24 hours for seven days. After about 24 hours in culture, the nitrogen supply in the media was completely depleted. The collected samples were immediately frozen using dry ice and isopropanol. Total RNA was subsequently isolated from the frozen cell pellet samples and a portion from each sample was held in reserve for RT-PCR studies. The rest of the total RNA harvested from the samples was subjected to polyA selection. Equimolar amounts of polyA selected RNA from each condition was then pooled and used to generate a cDNA library in vector pcDNA 3.0 (Invitrogen). Roughly 1200 clones were randomly picked from the resulting pooled cDNA library and subjected to sequencing on both strands. Approximately 68 different cDNAs were selected from among these 1200 sequences and used to design cDNA-specific primers for use in real-time RT-PCR studies.

RNA isolated from the cell pellet samples that were held in reserve was used as substrate in the real time RT-PCR studies using the cDNA-specific primer sets generated above. This reserved RNA was converted into cDNA and used as substrate for RT-PCR for each of the 68 gene specific primer sets. Threshold cycle or $C_T$ numbers were used to indicate relative transcript abundance for each of the 68 cDNAs within each RNA sample collected throughout the time course. cDNAs showing significant increase (greater than three fold) between nitrogen replete and nitrogen-depleted conditions were flagged as potential genes whose expression was up-regulated by nitrogen depletion. As discussed in the specification, nitrogen depletion/limitation is a known inducer of lipogenesis in oleaginous microorganisms.

In order to identify putative promoters/5'UTR sequences from the cDNAs whose expression was upregulated during nitrogen depletion/limitation, total DNA was isolated from *Prototheca moriformis* (UTEX 1435) grown under nitrogen replete conditions and were then subjected to sequencing using 454 sequencing technology (Roche). cDNAs flagged as being up-regulated by the RT-PCR results above were compared using BLAST against assembled contigs arising from the 454 genomic sequencing reads. The 5' ends of cDNAs were mapped to specific contigs, and where possible, greater than 500 bp of 5' flanking DNA was used to putatively identify promoters/UTRs. The presence of promoters/5'UTR were subsequently confirmed and cloned using PCR amplification of genomic DNA. Individual cDNA 5' ends were used to design 3' primers and 5' end of the 454 contig assemblies were used to design 5' gene-specific primers.

As a first screen, one of the putative promoters, the 5'UTR/promoter isolated from Aat2 (Ammonium transporter, SEQ ID NO: 63), was cloned into the *Cinnamomum camphora* C14 thioesterase construct with the *Chlorella protothecoides* stearoyl ACP desaturase transit peptide, replacing the *C sorokinana* glutamate dehydrogenase promoter. This construct is listed as SEQ ID NO: 81. To test the putative promoter, the thioesterase construct is transformed into *Prototheca moriformis* cells to confirm actual promoter activity by screening for an increase in C14/C12 fatty acids under low/no nitrogen conditions, using the methods described above.

Similar testing of the putative nitrogen-regulated promoters isolated from the cDNA/genomic screen can be done using the same methods.

Other putative nitrogen-regulated promoters/5'UTRs that were isolated from the cDNA/genomic screen were:

| Promoter/5'UTR | SEQ ID NO. | Fold increased |
| --- | --- | --- |
| FatB/A promoter/5'UTR | SEQ ID NO: 55 | n/a |
| NRAMP metal transporter promoter/5'UTR | SEQ ID NO: 56 | 9.65 |
| Flap Flagellar-associated protein promoter/5'UTR | SEQ ID NO: 57 | 4.92 |
| SulfRed Sulfite reductase promoter/5'UTR | SEQ ID NO: 58 | 10.91 |
| SugT Sugar transporter promoter/5'UTR | SEQ ID NO: 59 | 17.35 |
| Amt03-Ammonium transporter 03 promoter/5'UTR | SEQ ID NO: 60 | 10.1 |
| Amt02-Ammonium transporter 02 promoter/5'UTR | SEQ ID NO: 61 | 10.76 |
| Aat01-Amino acid transporter 01 promoter/5'UTR | SEQ ID NO: 62 | 6.21 |
| Aat02-Amino acid transporter 02 promoter/5'UTR | SEQ ID NO: 63 | 6.5 |
| Aat03-Amino acid transporter 03 promoter/5'UTR | SEQ ID NO: 64 | 7.87 |
| Aat04-Amino acid transporter 04 promoter/5'UTR | SEQ ID NO: 65 | 10.95 |
| Aat05-Amino acid transporter 05 promoter/5'UTR | SEQ ID NO: 66 | 6.71 |

Fold increase refers to the fold increase in cDNA abundance after 24 hours of culture in low nitrogen medium.

To gain further insight into potential regulation of these putative promoter/5'UTRs, eight of the sequences were selected for further testing: (1) FatB/A; (2) SulfRed Sulfite reductase; (3) SugT Sugar transporter; (4) Amt02-Ammonium transporter 02; (5) Aat01-Amino acid transporter 01; (6) Aat03-Amino acid transporter 03; (7) Aat04-Amino acid transporter 04; and (8) Aat05-Amino acid transporter 05. Higher resolution transcriptome analysis utilizing Illumina sequencing reads were carried out on RNA isolated from *Prototheca moriformis* cells various time points: T0 (seed); 20 hours; 32 hours; 48 hours; 62 hours; and 114 hours post inoculation from seed. The medium at T0 (seed) was nitrogen replete, while at the time points 20 hours and longer, the medium contained little to no nitrogen. Assembled transcript contigs generated from RNA isolated from each of the time points were then blasted independently with each of the eight previously identified transcripts. The results are summarized in Table 18 below.

TABLE 18

Transcriptome expression profiles for eight putative promoters/5'UTRs.

| cDNA | | TS | T20 | T32 | T48 | T62 | T114 |
| --- | --- | --- | --- | --- | --- | --- | --- |
| aa trans_01 | absolute | 98 | 96 | 321 | 745 | 927 | 1300 |
| | relative | 1 | 0.98 | 3.28 | 7.61 | 9.47 | 13.28 |
| aa trans_03 | absolute | 7 | 21 | 51 | 137 | 102 | 109 |
| | relative | 1 | 2.95 | 7.2 | 19.42 | 14.47 | 15.45 |
| aa trans_04 | absolute | 1 | 6 | 25 | 90 | 131 | 160 |
| | relative | 1 | 5.16 | 21.29 | 74.97 | 109.35 | 133.31 |
| aa trans_05 | absolute | 109 | 88 | 123 | 210 | 214 | 273 |
| | relative | 1 | 0.81 | 1.13 | 1.93 | 1.97 | 2.51 |
| ammon trans_02 | absolute | 683 | 173 | 402 | 991 | 1413 | 1397 |
| | relative | 1 | 0.25 | 0.59 | 1.45 | 2.07 | 2.04 |

TABLE 18-continued

Transcriptome expression profiles for eight putative promoters/5'UTRs.

| cDNA | | TS | T20 | T32 | T48 | T62 | T114 |
|---|---|---|---|---|---|---|---|
| fatA/B-1_cDNA | absolute | 13 | 36 | 654 | 617 | 544 | 749 |
| | relative | 1 | 2.8 | 51.57 | 48.65 | 42.9 | 59.1 |
| sug trans_01 | absolute | 25 | 25 | 106 | 261 | 266 | 251 |
| | relative | 1 | 1 | 4.22 | 10.4 | 10.63 | 10 |
| sulfite reductase_01 | absolute | 634 | 238 | 138 | 145 | 163 | 155 |
| | relative | 1 | 0.38 | 0.22 | 0.22 | 0.26 | 0.24 |

From the above-summarized results, several of the transcripts show increased accumulation over time, although interestingly, the sulfite reductase mRNA shows a distinct decrease in mRNA accumulation over time.

These eight putative promoter/5'UTR regions were cloned upstream of the *C camphora* thioesterase coding region with its native transit peptide taken out and substituted with the transit peptide from *Chlorella protothecoides* (UTEX 250) stearoyl ACP desaturase. Each putative promoter/5'UTR region construct was introduced into *Prototheca moriformis* UTEX 1435 via homologous recombination using DNA from the genomic sequence of 6S rRNA. Also contained within the construct is a suc2 sucrose invertase gene from *S. cerevisiae* for selection of positive clones on sucrose containing media/plates. The cDNA sequence for the relevant portions of the construct for Aat01 is listed in the Sequence Listing as SEQ ID NO: 67. For the other constructs, the same backbone was use, the only variable was the putative promoter/5'UTR sequence. An additional control transgenic strain was generated in which the *C. reinhardtii* beta tubulin promoter was used to drive expression of the *C. camphora* thioesterase gene. This promoter have shown to drive constitutive expression of the gene of interest, and thus provides a useful control against which to measure expression of the same thioesterase message when driven by the various putative N-regulated promoters/5'UTRs tested.

Once the transgenic clones were generated, three separate experiments were carried out. The first two experiments assess the potential nitrogen regulatability of all eight putative promoters by measuring steady state thioesterase mRNA levels via RT-PCR, fatty acid profiles and ammonia levels in the culture supernatants. Clones were initially grown at 28° C with agitation (200 rpm) in nitrogen rich seed medium (1 g/L ammonium nitrate-15 mM nitrogen as ammonia, 4 g/L yeast extract) for 24 to 48 hours, at which point 20 OD units ($A_{750}$) were used to inoculate 50 ml of low nitrogen media (0.2 g/L ammonium sulfate-3 mM nitrogen as ammonia, 0.2 g/L yeast extract). Cells were sampled every 24 hours for 6 days and a sample was also collected right before switching to low nitrogen conditions. A portion of the cells from each sample was then used for total RNA extraction using Trizol reagent (according to manufacturer's suggested methods). Ammonia assays revealed that ammonia levels in the supernatants fell below the limits of detection (~100 µM) after 24 hours in low nitrogen medium.

For real-time RT-PCR, all RNA levels were normalized to levels of an internal control RNA expressed in *Prototheca moriformis* (UTEX 1435) for each time point. The internal control RNA, termed cd189, is a product of the ARG9 gene which encodes N-acetyl ornithine aminotransferase. Primers sets used for real-time RT-PCR in these experiments were:

| Gene specific to | Primer sequence 5'-3' | SEQ ID NO: |
|---|---|---|
| C. camphora TE forward | TACCCCGCCTGGGGCGACAC | SEQ ID NO: 68 |
| C. camphora TE reverse | CTTGCTCAGGCGGCGGGTGC | SEQ ID NO: 69 |
| cd189 forward | CCGGATCTCGGCCAGGGCTA | SEQ ID NO: 70 |
| cd189 reverse | TCGATGTCGTGCACCGTCGC | SEQ ID NO: 71 |

Lipid profiles from each of the transformants from each time point were also generated and compared to the RT-PCR results. Based on the ammonia levels, RT-PCR results and changes in C12-C14 fatty acid levels, it was concluded that the Amino acid transporter 01 (Aat-01), Amino acid transporter 04 (Aat-04), and Ammonium transporter 02 (Amt-02) sequences do contain a functional nitrogen-regulatable promoter/5'UTR.

From the RT-PCR results, Aat-01 demonstrated the ability to drive steady state *C camphora* thioesterase mRNA levels up to four times higher than control (*C reinhardtii* beta tubulin promoter). The mRNA levels also correlated with nitrogen limitation and a marked increase in C12-C14 fatty acid levels. These results demonstrate that the 5'UTR associated with the Aat-01 promoter is likely more efficient at driving protein synthesis under lipid biosynthesis than the control *C reinhardtii* promoter. Like the Aat-01 promoter, the Aat-04 promoter was able to drive mRNA accumulation up to five times higher than that of the *C reinhardtii* control promoter. However, the Aat-04 promoter construct only produced a modest ability to impact C12-C14 fatty acid levels. These data demonstrate that the Aat-04 promoter is clearly regulatable by nitrogen depletion, but the UTR associated with the promoter likely functions poorly as a translational enhancer. Finally, the Amt-02 promoter was similar to the Aat-01 promoter, in that it was able to drive mRNA accumulation up to three times higher than that of the control promoter. The mRNA levels also correlated with nitrogen limitation and a marked increase in C12-C14 fatty acid levels. Taken together, all three of these promoters were demonstrated to be nitrogen-regulated.

B. Further Characterization of the Ammonium Transporter 3 (Amt03) Promoter and Expression of Various Thioesterases.

As described above, partial cDNAs termed ammonium transporter $O_2$ and 03 (amt02 and amt03) were identified. Along with these two partial cDNAs, a third partial cDNA termed ammonium transporter 01 (amt01) was also identified. Alignment of the partial cDNA and the putative translated amino acid sequences were compared. Results show amt01 to be more distantly related of the three sequences, while amt02 and amt03 differ by only a single amino acid.

Promoters/5'UTRs were generated initially in silico by blasting the partial cDNA sequences against Roche 454 genomic DNA assemblies and Illumina transcriptome assemblies as described above. Transcript contigs showing identity to the cDNA encoding amt01, amt02, and amt03 were identified, however, the transcript contigs could not differentiate between the three mRNAs as the contigs contained sequences shared by all three. Roche 454 genomic DNA assemblies gave hits to amt02 and amt03 cDNA sequences and contained N-terminal protein sequences. PCR was carried out to clone the 5' flanking regions. The PCR primers used to validate the clone amt02 and amt03 promoter/UTR were:

```
Amt03 forward:
                                (SEQ ID NO: 85)
5'-GGAGGAATTCGGCCGACAGGACGCGCGTCA-3'

Amt03 reverse:
                                (SEQ ID NO: 86)
5'-GGAGACTAGTGGCTGCGACCGGCCTGTG-3'

Amt02 forward:
                                (SEQ ID NO: 87)
5'-GGAGGAATTCTCACCAGCGGACAAAGCACCG-3'

Amt02 reverse:
                                (SEQ ID NO: 88)
5'-GGAGACTAGTGGCTGCGACCGGCCTCTGG-3'
```

In both cases, the 5' and 3' primers contained useful restriction sites for the anticipated cloning into expression vectors to validate the functionality of these promoter/5'UTR regions.

Pair wise alignments between the DNAs cloned through this combined in silico and PCR-based method and the original cDNA encoding amt02 (SEQ ID NO: 61) and amt03 (SEQ ID NO: 60) were performed. Results of these alignments showed significant differences between the original cDNAs and the cloned genomic sequences, indicating that ammonium transporters likely represent a diverse gene family. Additionally, the promoter/5'UTR clone based on the combined method for amt03 was different than the original amt03 sequence, whereas the amt02 sequences were identical. Further experiments to characterize the amt03 promoter/UTR sequence (SEQ ID NO: 89) was carried out and described below.

The above identified amt03 promoter/UTR sequence (SEQ ID NO: 89) was tested by cloning this putative promoter/UTR sequence to drive the expression of four different thioesterases. The expression cassette contained upstream and downstream homologous recombination sequences to the 6S locus of the genome (SEQ ID NOs: 82 and 84, respectively). The cassette also contains a *S. cerevisiae* SUC2 sucrose invertase cDNA to enable the selection for positive clones on sucrose containing medium. The sucrose invertase expression was driven by the *C reinhardtii* beta tubulin promoter and also contained a *C vulgaris* nitrate reductase 3'UTR. The amt03 promoter/UTR sequence was then cloned downstream of the sucrose invertase cassette followed by in-frame thioesterase cDNA sequence from one of four thioesterase genes: (1) C14 thioesterase from *C camphora*; (2) C12 thioesterase from *U. californica*; (3) C10-C16 thioesterase from *U. americana*; or (4) C10 thioesterase from *C. hookeriana* and also contained a *C. vulgaris* nitrate reductase 3'UTR. The C14 *C camphora* thioesterase, C12 *U. californica* thioesterase, and the C10-C16 *U. americana* all contained the transit peptide from a *Chlorella protothecoides* stearoyl ACP desaturase. The C10 *C. hookeriana* thioesterase contained the transit peptide from a *Prototheca moriformis* delta 12 fatty acid desaturase (FAD). In all cases, the sequences were codon optimized for expression in *Prototheca moriformis*. The sequences to the foregoing thioesterase constructs are described in the Sequence Listing:

| | |
|---|---|
| amt03 promoter/UTR::*C. camphora* thioesterase construct | SEQ ID NO: 90 |
| *C. camphora* thioesterase construct | SEQ ID NO: 91 |
| *U. californica* thioesterase construct | SEQ ID NO: 92 |
| *U. americana* thioesterase construct | SEQ ID NO: 93 |
| *C. hookeriana* thioesterase construct | SEQ ID NO: 94 |

Transgenic lines were generated via biolistic transformation methods as described above in Example 2 into wild type *Prototheca moriformis* cells and selection was carried out on sucrose containing plates/medium. Positive lines were then screened for the degree to which their fatty acid profiles were altered. Four lines, one resulting from the transformation with each of the four above-described constructs, were then subjected to additional analysis. Line 76 expressed the *C. camphora* C14 thioesterase, line 37 expressed the *U. californica* C12 thioesterase, line 60 expressed the *U. americana* C10-C16 thioesterase, and line 56 expressed the *C. hookeriana* C10 thioesterase. Each line was grown for 48 hours in medium containing sucrose as the sole carbon source and samples of cells were removed at 14, 24, 36 and 48 hours (seed culture) for determination of fatty acid profile via direct transesterification to fatty acid methyl esters and subsequent analysis by GC-FID (described above) and for isolation of total RNA. At the end of 48 hours, these cells were used to inoculate cultures with no or low levels of nitrogen (containing sucrose as the sole carbon source) maintained at either pH 5.0 (citrate buffered, 0.05M final concentration) or pH 7.0 (HEPES buffered, 0.1M final concentration). Culture samples were removed at 12, 24, 72 and 108 hours (lipid production) for fatty acid profiling and isolation of total RNA Ammonia assays of these cultures revealed that ammonia levels fell below the limits of detection (ca. 100 μM) after 24 hours in low nitrogen medium.

Real-time RT-PCR assays on the mRNA levels of the thioesterases were performed on total RNA from each of the time points collected above and all mRNA levels were normalized to the levels of an internal control RNA (cd189). Primer sets used in real-time PCR are shown in Table 19 below:

TABLE 19

Primer sets for real-time PCR.

| Gene specific to | Primer sequence 5'-3' | SEQ ID NO: |
|---|---|---|
| *C. camphora* TE forward | TACCCCGCCTGGGGCGACAC | SEQ ID NO: 68 |
| *C. camphora* TE reverse | CTTGCTCAGGCGGCGGGTGC | SEQ ID NO: 69 |

TABLE 19-continued

Primer sets for real-time PCR.

| Gene specific to | Primer sequence 5'-3' | SEQ ID NO: |
|---|---|---|
| U. californica TE forward | CTGGGCGACGGCTTCGGCAC | SEQ ID NO: 95 |
| U. californica TE reverse | AAGTCGCGGCGCATGCCGTT | SEQ ID NO: 96 |
| U. americana TE forward | CCCAGCTGCTCACCTGCACC | SEQ ID NO: 97 |
| U. americana TE reverse | CACCCAAGGCCAACGGCAGCGCCGTG | SEQ ID NO: 98 |
| C. hookeriana TE forward | TACCCCGCCTGGGGCGACAC | SEQ ID NO: 99 |
| C. hookeriana TE reverse | AGCTTGGACAGGCGGCGGGT | SEQ ID NO: 100 |
| cd189 reverse | TCGATGTCGTGCACCGTCGC | SEQ ID NO: 71 |
| cd189 forward | CCGGATCTCGGCCAGGGCTA | SEQ ID NO: 70 |

The results from the fatty acid profiles at each of the time points in the seed culture phase showed very little impact from the thioesterases. With the commencement of the lipid production phase, the fatty acid profiles were significantly impacted, with the increases that are far more dramatic for the cultures maintained at pH 7.0 as compared to the cultures at pH 5.0. While the magnitude of the difference between pH 7.0 and 5.0 target fatty acid accumulation varied with each thioesterase tested, the overall effect was the same: that the cells grown at pH 5.0 showed significantly lower levels of the target fatty acids accumulated, but more than compared to control wild type cells.

Analysis of the RNA isolated from these same samples correlated very will with the fatty acid profile data, in that there was a clear impact of culture pH on the steady state mRNA levels for each of the thioesterases. Taking the fatty acid accumulation data and the mRNA data together, the pH regulation of thioesterase gene expression driven by the amt03 promoter/UTR was clearly mediated either at the level of transcription, mRNA stability or both. Additionally, it was observed that the steady state levels of U. californica mRNA were four logs lower as compared to the steady state levels of C. hookeriana mRNA. This observation is consistent with the hypothesis that the individual mRNA sequences may play a role in controlling expression. These data imply that ammonium uptake in Prototheca moriformis by the amt03 family of transporters is coupled directly to pH.

Additional fatty acid profile analysis was performed on twelve lines generated from the transformation of Prototheca moriformis cells with the construct amt03 promoter/UTR driving the expression of the U. americana C10-C16 thioesterase. Line 60, described above, was a part of the following analysis. Table 20 below shows the lipid profiles of three of the twelve lines that were analyzed along with the wild type control.

As shown in the table above, the levels of total saturates was increased dramatically over that of wild type with over 2.6 fold in the case of line 40 compared to wildtype (total saturates from the twelve lines analyzed ranged from about 63% to over 86%). Additionally, the U. americana thioesterase, when expressed at these levels, dramatically reduces the level of unsaturates, especially C18:1 and C18:2 (see lines 40 and 44), where in line 44, C18:1 levels are reduced by over 8 fold compared to the wild type. Also, the U. americana thioesterase (driven by the amt03 promoter) greatly increases the levels of mid-chain fatty acids. Line 44 shows C10:0-C14:0 levels at greater than 56%, approximately 42 fold higher than the levels seen in the wildtype strain and C8:0-C14:0 levels at greater than 57%. Additional strains transformed with a construct of the Amt03 promoter driving the expression of the U. americana thioesterase had representative lipid profile of: 0.23% C8:0; 9.64% C10:0; 2.62% C12:0; 31.52% C14:0; 37.63% C16:0; 5.34% C18:0; 7.05% C18:1; and 5.03% C18:2, with a total saturates percentage at 86.98%.

Additional lipid profiles generated from the transformation of Prototheca moriformis cells with the construct amt03 promoter/UTR (SEQ ID NO: 89) driving the expression of the C. hookeriana C10 thioesterase (SEQ ID NO: 94). Positive clones expressing this construct were selected and grown at pH 7.0 conditions. Representative lipid profile from a positive clone was: 9.87% C8:0; 23.97% C10:0; 0.46% C12:0; 1.24% C14:0; 10.24% C16:0; 2.45% C18:0; 42.81% C18:1; and 7.32% C18:2. This clone had a C8-C10 percentage of 33.84

Taken together, the data suggest that the amt03 promoter/UTR, and other promoters like it, can be used as a tightly regulated promoter, which may be particularly useful for expressing a potentially toxic compound and strict enforcement of gene expression is required. The ability of Prototheca moriformis to grow under a wide range (at least pH 5.0 to 7.0) of pH regimes makes this organism particularly useful in combination with regulatory elements such as the amt03 pro-

TABLE 20

Fatty acid profiles of transformants containing the
U. americana TE driven by the amt03 promoter/UTR.

| Area % | C8:0 | C10:0 | C12:0 | C14:0 | C16:0 | C18:0 | C18:1 | C18:2 | Total Saturates |
|---|---|---|---|---|---|---|---|---|---|
| wild type | 0.00 | 0.01 | 0.04 | 1.27 | 27.20 | 3.85 | 58.70 | 7.18 | 32.36 |
| Line 40 | 2.38 | 20.61 | 3.41 | 28.41 | 29.92 | 1.91 | 8.57 | 3.74 | 86.64 |
| Line 44 | 1.50 | 20.16 | 4.44 | 31.88 | 26.66 | 1.88 | 6.95 | 5.42 | 86.50 |
| Line 60 | 0.98 | 14.56 | 3.15 | 27.49 | 31.76 | 2.14 | 12.23 | 6.36 | 80.06 | moter/UTR. Additionally, the lipid profile data above demonstrates the impressive ability of the amt03 promoter/UTR to drive gene expression.

Example 11

Altering the Levels of Saturated Fatty Acids in the Microalgae *Prototheca moriformis*

As part of a genomics screen using a bioinformatics based approach based on cDNAs, Illumia transcriptome and Roche 454 squencing of genomic DNA from *Prototheca* moriformis (UTEX 1435), two specific groups of genes involved in fatty acid desaturation were identified: stearoyl ACP desaturases (SAD) and delta 12 fatty acid desaturases (∆12 FAD). Stearoyl ACP desaturase enzymes are part of the lipid synthesis pathway and they function to introduce double bonds into the fatty acyl chains, for example, the synthesis of C18:1 fatty acids from C18:0 fatty acids. Delta 12 fatty acid desaturases are also part of the lipid synthesis pathway and they function to introduce double bonds into already unsaturated fatty acids, for example, the synthesis of C18:2 fatty acids from C18:1 fatty acids. Southern blot analysis using probes based on the two classes of fatty acid desaturase genes identified during the bioinformatics efforts indicated that each class of desaturase genes was likely comprised of multiple family members. Additionally the genes encoding stearoyl ACP desaturases fell into two distinct families. Based on these results, three gene disruption constructs were designed to potentially disrupt multiple gene family members by targeting more highly conserved coding regions within each family of desaturase enzymes.

Three homologous recombination targeting constructs were designed using: (1) highly conserved portions of the coding sequence of delta 12 fatty acid desaturase (d12FAD) family members and (2) two constructs targeting each of the two distinct families of SAD, each with conserved regions of the coding sequences from each family. This strategy would embed a selectable marker gene (the suc2 sucrose invertase cassette from *S. cerevisiae* conferring the ability to hydrolyze sucrose) into these highly conserved coding regions (targeting multiple family members) rather than a classic gene replacement strategy where the homologous recombination would target flanking regions of the targeted gene.

All constructs were introduced into the cells by biolistic transformation using the methods described above and constructs were linearized before being shot into the cells. Transformants were selected on sucrose containing plates/media and changes in lipid profile were assayed using the above-described method. Relevant sequences from each of the three targeting constructs are listed below.

| Description | SEQ ID NO: |
|---|---|
| 5' sequence from coding region of d12FAD from targeting construct | SEQ ID NO: 72 |
| 3' sequence from coding region of d12FAD from targeting construct | SEQ ID NO: 73 |
| d12FAD targeting construct cDNA sequence | SEQ ID NO: 74 |
| 5' sequence from coding region of SAD2A | SEQ ID NO: 75 |
| 3' sequence from coding region of SAD2A | SEQ ID NO: 76 |
| SAD2A targeting construct cDNA sequence | SEQ ID NO: 77 |
| 5' sequence from coding region os SAD2B | SEQ ID NO: 78 |
| 3' sequence from coding region of SAD2B | SEQ ID NO: 79 |
| SAD2B targeting construct cDNA sequence | SEQ ID NO: 80 |

Representative positive clones from transformations with each of the constructs were picked and the lipid profiles for these clones were determined (expressed in Area %) and summarized in Table 21 below.

TABLE 21

Lipid profiles for desaturase knockouts.

| Fatty Acid | d12FAD KO | SAD2A KO | SAD2B KO | wt UTEX 1435 |
|---|---|---|---|---|
| C8:0 | 0 | 0 | 0 | 0 |
| C10:0 | 0.01 | 0.01 | 0.01 | 0.01 |
| C12:0 | 0.03 | 0.03 | 0.03 | 0.03 |
| C14:0 | 1.08 | 0.985 | 0.795 | 1.46 |
| C16:0 | 24.42 | 25.335 | 23.66 | 29.87 |
| C18:0 | 6.85 | 12.89 | 19.555 | 3.345 |
| C18:1 | 58.35 | 47.865 | 43.115 | 54.09 |
| C18:2 | 7.33 | 10.27 | 9.83 | 9.1 |
| C18:3 alpha | 0.83 | 0.86 | 1 | 0.89 |
| C20:0 | 0.48 | 0.86 | 1.175 | 0.325 |

Each of the construct had a measurable impact on the desired class of fatty acid and in all three cases C18:0 levels increased markedly, particularly with the two SAD knockouts. Further comparison of multiple clones from the SAD knockouts indicated that the SAD2B knockout lines had significantly greater reductions in C18:1 fatty acids than the C18:1 fatty acid levels observed with the SAD2A knockout lines.

Additional ∆12 fatty acid desaturase (FAD) knockouts were generated in a *Prototheca moriformis* background using the methods described above. In order to identify potential homologous of ∆12FADs, the following primers were used in order to amplify a genomic region encoding a putative FAD:

```
Primer 1
                                SEQ ID NO: 101
5'-TCACTTCATGCCGGCGGTCC-3'

Primer 2
                                SEQ ID NO: 102
5'-GCGCTCCTGCTTGGCTCGAA-3'
```

The sequences resulting from the genomic amplification of *Prototheca moriformis* genomic DNA using the above primers were highly similar, but indicated that multiple genes or alleles of ∆12FADs exist in *Prototheca*.

Based on this result, two gene disruption constructs were designed that sought to inactivate one or more ∆12FAD genes. The strategy would to embed a sucrose invertase (suc2 from *S. cerevisiae*) cassette, thus conferring the ability to hydrolyze sucrose as a selectable marker, into highly conserved coding regions rather than use a classic gene replacement strategy. The first construct, termed pSZ1124, contained 5' and 3' genomic targeting sequences flanking a *C. reinhardtii* β-tubulin promoter driving the expression of the *S. cerevisiae* suc2 gene and a *Chlorella vulgaris* nitrate reductase 3'UTR (*S. cerevisiae* suc2 cassette). The second construct, termed pSZ1125, contained 5' and 3' genomic targeting sequences flanking a *C. reinhardtii* β-tubulin promoter driving the expression of the *S. cerevisiae* suc2 gene and a *Chlorella vulgaris* nitrate reductase 3'UTR. The relevant sequences of the constructs are listed in the Sequence Listing:

| | |
|---|---|
| pSZ1124 (FAD2B) 5' genomic targeting sequence | SEQ ID NO: 103 |
| pSZ1124 (FAD2B) 3' genomic targeting sequence | SEQ ID NO: 104 |
| *S. cerevisiae* suc2 cassette | SEQ ID NO: 105 |
| pSZ1125 (FAD2C) 5' genomic targeting sequence | SEQ ID NO: 106 |
| pSZ1125 (FAD2C) 3' genomic targeting sequence | SEQ ID NO: 107 | pSZ1124 and pSZ1125 were each introduced into a *Prototheca moriformis* background and positive clones were selected based on the ability to hydrolyze sucrose. Table 22 summarizes the lipid profiles (in Area %, generated using methods described above) obtained in two transgenic lines in which pSZ1124 and pSZ1125 targeting vectors were utilized.

TABLE 22

Lipid profiles of Δ12 FAD knockouts

|  | C10:0 | C12:0 | C14:0 | C16:0 | C16:1 | C18:0 | C18:1 | C18:2 | C18:3α |
|---|---|---|---|---|---|---|---|---|---|
| parent | 0.01 | 0.03 | 1.15 | 26.13 | 1.32 | 4.39 | 57.20 | 8.13 | 0.61 |
| FAD2B | 0.02 | 0.03 | 0.80 | 12.84 | 1.92 | 0.86 | 74.74 | 7.08 | 0.33 |
| FAD2C | 0.02 | 0.04 | 1.42 | 25.85 | 1.65 | 2.44 | 66.11 | 1.39 | 0.22 |

The transgenic containing the FAD2B (pSZ1124) construct gave a very interesting and unexpected result in lipid profile, in that the C18:2 levels, which would be expected to decrease, only decreased by about one area %. However, the C18:1 fatty acid levels increased significantly, almost exclusively at the expense of the C16:0 levels, which decreased significantly. The transgenic containing the FAD2C (pSZ1125) construct also gave a change in lipid profile: the levels of C18:2 are reduced significantly along with a corresponding increase in C18:1 levels.

Beef Tallow Mimetic

One positive clone generated from the above SAD2B knockout experiment as described above was selected to be used as the background for the further introduction of a C14-preferring fatty acyl-ACP thioesterase gene. The construct introducing the C camphora C14-preferring thioesterase contained targeting sequence to the 6S rRNA genomic region (allowing for targeted integration of the transforming DNA via homologous recombination) and the expression construct contained the C reinhardtii β-tubulin promoter driving the expression of the neoR gene with the Chlorella vulgaris nitrate reductase 3'UTR, followed by a second C reinhardtii β-tubulin promter driving the expression of a codon-optimized C camphora thioesterase with a Chlorella prototh-ecoides stearoyl ACP desaturase transit peptide with a second Chlorella vulgaris nitrate reductase 3'UTR. The 5' 6S rRNA genomic donor sequence is listed in SEQ ID NO: 82; the 3' 6S rRNA genomic donor sequence is listed in SEQ ID NO: 84; and the relevant expression construct for the C camphora thioesterase is listed in SEQ ID NO: 83.

Transformation was carried out using biolistic methods as described above and the cells were allowed to recover for 24 hours on plates containing 2% sucrose. After this time, the cells were re-suspended and re-plated on plates containing 2% sucrose and 50 μg/ml G418 for selection. Nine clones out of the positive clones generated were selected for lipid production and lipid profile. The nine transgenic clones (with the SAD2B KO and expressing C. camphora C14-preferring thioesterase) were cultured as described above and analyzed for lipid profile. The results are summarized below in Table 23. The lipid profile for tallow is also included in Table 23 below (National Research Council 1976: Fat Content and Composition of Animal Product).

TABLE 23

Lipid profile of thioesterase transformed clones.

|  | C10:0 | C12:0 | C14:0 | C16:0 | C16:1 | C18:0 | C18:1 | C18:2 | C18:3 | C20 |
|---|---|---|---|---|---|---|---|---|---|---|
| SAD2BKO C. camphora TE clone 1 | 0.01 | 0.33 | 6.13 | 24.24 | 0.19 | 11.08 | 42.03 | 13.45 | 0.98 | 0.73 |
| SAD2BKO C. camphora TE clone 2 | 0.01 | 0.16 | 3.42 | 23.80 | 0.40 | 9.40 | 50.62 | 10.2 | 0.62 | 0.70 |
| SAD2BKO C. camphora TE clone 3 | 0.01 | 0.20 | 4.21 | 25.69 | 0.40 | 7.79 | 50.51 | 9.37 | 0.66 | 0.63 |
| SAD2BKO C. camphora TE clone 4 | 0.01 | 0.21 | 4.29 | 23.57 | 0.31 | 9.44 | 50.07 | 10.07 | 0.70 | 0.70 |
| SAD2BKO C. camphora TE clone 5 | 0.01 | 0.18 | 3.87 | 24.42 | 0.32 | 9.24 | 49.75 | 10.17 | 0.71 | 0.71 |
| SAD2BKO C. camphora TE clone 6 | 0.01 | 0.28 | 5.34 | 23.78 | 0.33 | 9.12 | 49.12 | 10.00 | 0.68 | 0.70 |
| SAD2BKO C. camphora TE clone 7 | 0.01 | 0.15 | 3.09 | 23.07 | 0.32 | 10.08 | 51.21 | 10.00 | 0.66 | 0.74 |
| SAD2BKO C. camphora TE clone 8 | 0.01 | 0.29 | 5.33 | 24.62 | 0.37 | 7.02 | 49.67 | 10.74 | 0.69 | 0.70 |
| SAD2BKO C. camphora TE clone 9 | 0.01 | 0.12 | 2.74 | 25.13 | 0.30 | 10.17 | 50.18 | 9.42 | 0.71 | 0.71 |
| wt UTEX 1435 | 0.01 | 0.02 | 0.96 | 23.06 | 0.79 | 3.14 | 61.82 | 9.06 | 0.46 | 0.27 |
| SAD2BKO | 0.01 | 0.03 | 0.80 | 23.66 | 0.13 | 19.56 | 43.12 | 9.83 | 1.00 | 1.18 |
| Tallow | 0.00 | 0.00 | 4.00 | 26.00 | 3.00 | 14.00 | 41.00 | 3.00 | 1.00 | 0.00 |

As can be seen in Table 23, the lipid profiles of the transgenic lines are quite similar to the lipid profile of tallow. Taken collectively, the data demonstrate the utility of combining specific transgenic backgrounds, in this case, a SAD2B knockout with a C14-preferring thioesterase (from *C camphora*), to generate an transgenic algal strain that produce oil similar to the lipid profile of tallow.

Construct Used to Down Regulate the Expression of β-Ketoacyl Synthase II (KASII) by Targeted Knock-Out Approach Vector down-regulating KASII gene expression by targeted knock-out approach was introduced into a classically mutagenized derivative of UTEX 1435, S1331. The *Saccharomyces cerevisiae* invertase gene was utilized as a selectable marker, conferring the ability to grow on sucrose. The invertase expression cassette under control of *C reinhardtii* B-tubulin promoter was inserted in the middle of the 315 bp long KASII genomic region to permit targeted integration (pSZ1503).

Relevant restriction sites in pSZ1503 are indicated in lowercase, bold and underlining and are 5'-3' BspQ 1, Kpn I, AscI, Xho I, Sac I, BspQ I, respectively. BspQI sites delimit the 5' and 3' ends of the transforming DNA. Bold, lowercase sequences represent genomic DNA from S1331 that permit targeted integration at KASII locus via homologous recombination. Proceeding in the 5' to 3' direction, the *C. reinhardtii* B-tubulin promoter driving the expression of the yeast sucrose invertase gene (conferring the ability of S1331 to metabolize sucrose) is indicated by boxed text. The initiator ATG and terminator TGA for invertase are indicated by uppercase, bold italics while the coding region is indicated in lowercase italics. The *Chlorella vulgaris* nitrate reductase 3' UTR is indicated by lowercase underlined text.

Nucleotide sequence of transforming DNA contained in pSZ1503_[KASII_btub-y.inv-nr_KASII]:

```
gctcttcccgcaccggctggctccaccccaacttgaacctcgagaacccgcgcctggcgtcgaccccgtcgtgctcgtggggc cgcggaaggagcgcgccgaagacctggacgtcgtcctcctccaactcctttggctttggcgggcacaattcgtgcgtcggtacc cttcttgcgctatagacacttccagcaaaaggtagggcgggctgcgagacggcttcccggcgctgcatgcaacaccgatgatgcttcg accccccgaagctccttcggggctgcatgggcgctccgatgccgctccagggcgagcgctgtttaaatagccaggcccccgattgc aaagacattatagcgagctaccaaagccatattcaaacacctagatcactaccacttctacacaggccactcgagcttgtgatcgcactc cgctaagggggcgcctcttcctcttcgtttcagtcacaaccgcaaacggcgcgccATGctgctgcaggccttcctgttcctgctgg ccggcttcgccgccaagatcagcgcctccatgacgaacgagacgtccgaccgcccctggtgcacttcaccccaacaagggct ggatgaacgaccccaacggcctgtggtacgacgagaaggacgccaagtggcacctgtacttccagtacaacccgaacgacac cgtctgggggacgcccttgttctggggcacgccacgtccgacgacctgaccaactgggaggaccagcccatcgccatcgcccc gaagcgcaacgactccggcgccttctccggctccatggtggtggactacaacaacacctccggcttcttcaacgacaccatcgac ccgcgccagcgctgcgtggccatctggacctacaacaccccggagtccgaggagcagtacatctcctacagcctggacggcgg ctacaccttcaccgagtaccagaagaaccccgtgctggccgccaactccacccagttccgcgacccgaaggtcttctggtacgag ccctcccagaagtggatcatgaccgcggccaagtcccaggactacaagatcgagatctactcctccgacgacctgaagtcctgg aagctggagtccgcgttcgccaacgaggcttctcggctaccagtacgagtgccccggcctgatcgaggtcccaccgagcag gaccccagcaagtcctactgggtgatgttcatctccatcaacccgcggccccggccggcggctccttcaaccagtattcgtcgg cagcttcaacggcacccacttcgaggccttcgacaaccagtcccgcgtggtggacttcggcaaggactactacgccctgcagacc ttcttcaacaaccgacccgacctacgggagcgccctgggcatcgcgtgggcctccaactgggagtactccgcttcgtgcccacca acccctggcgctcctccatgtccctcgtgcgcaagttctcctcaacaccgagtaccaggccaacccggagacggagctgatcaa cctgaaggccgagccgatcctgaacatcagcaacgccggcccctggagccggttcgccaccaacaccacgttgacgaaggcc aacagctacaacgtcgacctgtccaacagcacggcaccctggagttcgagctggtgtacgccgtcaacaccacccagacgatc tccaagtccgtgttcgcggacctctccctctggttcaagggcctggaggaccccgaggagtacctccgcatgggcttcgaggtgtc cgcgtcctccttcttcctggaccgcgggaacagcaaggtgaagttcgtgaaggagaaccctacttcaccaaccgcatgagcgtg aacaaccagcccttcaagagcgagaacgacctgtcctactacaaggtgtacggcttgctggaccagaacatcctggagctgtact tcaacgacggcgacgtcgtgtccaccaacacctacttcatgaccaccgggaacgccctgggctccgtgaacatgacgacggg gtggacaacctgttctacatcgacaagttccaggtgcgcgaggtcaagTGAcaattggcagcagcagctcggatagtatcgac acactctggacgctggtcgtgtgatggactgttgccgccacacttgctgccttgacctgtgaatatccctgccgcttttatcaaacagcct cagtgtgtttgatcttgtgtg-
tacgcgcttttgcgagttgctagctgcttgtgctatttgcgaataccacccccagcatcccctttcctcgttt
```

-continued catatcgcttgatcccaaccgcaacttatctacgctgtcctgctatccctcagcgctgctcctgctcctgctcactgcccctcgcacagc cttggtttgggctccgcctgtattctcctggtactgcaacctgtaaaccagcactgaatgctgatgcacgggagtagtgggatggga acacaaatggaggatcgta<u>gagctcatcttccgaaagtacgacgagtgagcgagctgattctctttgagcggggtcgggtggttc ggggagagtgcgcggaaaggcgcagagacgtgcggccggccgtgtccctccgtcttccc</u>ctggttggtgctatagtaacctgc ctgtgtcgcgtgcgcgtcgggaagagc (SEQ ID NO: 149)

The cDNAs of the KAS II allele 1 and allele 2 are identified in SEQ ID NOs: 279 and 280, respectively. The amino acid sequences of alleles 1 and 2 are identified in SEQ ID NOs: 281 and 282, respectively.

To determine the impact of KASII inactivation on lipid composition, pSZ1503 vector DNA was transformed into S1331 to generate a targeted KASII knock-out phenotype. Initial single clones were isolated and grown under standard lipid production conditions at pH5.0. The resulting profiles of the best representative clone and the wild-type cells are shown below in Table 23A.

| S. carlbergensis MEL1 amino acid sequence | SEQ ID NO: 108 |
| S. carlbergensis MEL1 amino acid sequence signal peptide | SEQ ID NO: 109 |
| S. carlbergensis MEL1 transformation cassette | SEQ ID NO: 110 |
| S. carlbergensis MEL1 sequence (codon optimized) | SEQ ID NO: 111 |
| 5' Clp homologous recombination targeting sequence | SEQ ID NO: 112 |
| 3' Clp homologous recombination targeting sequence | SEQ ID NO: 113 |
| Chlamydomonas reinhardtii TUB2 promoter/5'UTR | SEQ ID NO: 114 |
| Chlorella vulgaris nitrate reductase 3'UTR | SEQ ID NO: 115 |
| A. niger AlgC amino acid sequence | SEQ ID NO: 116 |

TABLE 23A

Fatty acid profiles in S1331 and a derivative transgenic line transformed with pSZ1503 DNA.

| Sample ID | C10:0 | C12:0 | C14:0 | C16:0 | C16:1 | C18:0 | C18:1 | C18:2 | C18:3 α |
|---|---|---|---|---|---|---|---|---|---|
| 1331-5 | 0.01 | 0.03 | 0.96 | 24.28 | 0.64 | 3.94 | 62.69 | 6.21 | 0.49 |
| D698-2 | 0.01 | 0.01 | 0.83 | 38.36 | 1.38 | 2.21 | 48.31 | 7.60 | 0.55 |

Example 12

Engineering *Prototheca* with Alternative Selectable Markers

A. Expression of a Secretable α-Galactosidase in *Prototheca moriformis*

Methods and effects of expressing a heterologous sucrose invertase gene in *Prototheca* species have been previously described in PCT Application No. PCT/US2009/66142, hereby incorporated by reference. The expression of other heterologous polysaccharide degrading enzymes was examined in this Example. The ability to grow on melibiose (α-D-gal-glu) by *Prototheca moriformis* UTEX 1435 with one of the following exogenous gene encoding a α-galactosidase was tested: MEL1 gene from *Saccharomyces* carlbergensis (amino acid sequence corresponding to NCBI accession number P04824 (SEQ ID NO: 108)), AglC gene from *Aspergillus niger* (amino acid sequence corresponding to NCBI accession number Q9UUZ4 (SEQ ID NO: 116)), and the α-galactosidase from the higher plant *Cyamopsis tetragoboloba* (Guar bean) (amino acid sequence corresponding to NCBI accession number P14749 (SEQ ID NO: 120). The above accession numbers and corresponding amino acid sequences are hereby incorporated by reference. In all cases, genes were optimized according to the preferred codon usage in *Prototheca moriformis*. The relevant portions of the expression cassette are listed below along with the Sequence Listing numbers. All expression cassettes used the 5' and 3' Clp homologous recombination targeting sequences for stable genomic integration, the *Chlamydomonas reinhardtii* TUB2 promoter/5'UTR, and the *Chlorella vulgaris* nitrate reductase 3'UTR.

-continued

| A. niger AlgC amino acid sequence signal peptide | SEQ ID NO: 117 |
| A. niger AlgC sequence (codon optimized) | SEQ ID NO: 118 |
| A. niger AlgC transformation cassette | SEQ ID NO: 119 |
| C. tetragonobola α-galactosidase amino acid sequence | SEQ ID NO: 120 |
| C. tetragonobola α-galactosidase sequence (codon optimized) | SEQ ID NO: 121 |
| C. tetragonobola α-galactosidase transformation cassette | SEQ ID NO: 122 |

*Prototheca moriformis* cells were transformed with each of the three expression cassettes containing *S. carlbergensis* MEL1, *A. niger* AlgC, or *C tetragonobola* α-galactosidase gene using the biolistic transformation methods as described in Example 2 above. Positive clones were screened using plates containing 2% melibiose as the sole carbon source. No colonies appeared on the plates for the *C tetragonobola* expression cassette transformants. Positive clones were picked from the plates containing the *S. carlbergensis* MEL1 transformants and the *A. niger* AlgC transformants. Integration of the transforming DNA was confirmed using PCR with primers targeting a portion of the *C vulgaris* 3'UTR and the 3' Clp homologous recombination targeting sequence.

```
5' primer C.vulgaris 3'UTR: downstream Clp
sequence
                              (SEQ ID NO: 123)
ACTGCAATGCTGATGCACGGGA 3' primer C.vulgaris 3'UTR: downstream Clp
sequence
                              (SEQ ID NO: 124)
TCCAGGTCCTTTTCGCACT
```

As a negative control, genomic DNA from untransformed *Prototheca moriformis* cells were also amplified with the primer set. No products were amplified from genomic DNA from the wild type cells.

Several positive clones from each of the *S. carlbergensis* MEL1 transformants and the *A. niger* AlgC transformants (as confirmed by PCR) were tested for their ability to grow on melibiose as the sole carbon source in liquid media. These selected clones were grown for 3 days in conditions and base medium described in Example 1 above with melibiose as the sole carbon source. All clones containing either α-galactosidase-encoding genes grew robustly during this time, while the untransformed wild type strain and *Prototheca moriformis* expressing a *Saccharomyces cerevisiae* SUC2 sucrose invertase both grew poorly on the melibiose media. These results suggest that the α-galactosidase encoding genes may be used as a selectable marker for transformation. Also, these data indicate that the native signal peptides present in the *S. carlbergensis* MEL1 (SEQ ID NO: 109) or *A. niger* AlgC (SEQ ID NO: 117) are useful for targeting proteins to the periplasm in *Prototheca moriformis* cells.

B. THIC Genes Complements Thiamine Auxotrophy in *Prototheca*

Thiamine prototrophy in *Prototheca moriformis* cells was examined using expression of exogenous THIC genes. Thiamine biosynthesis in plants and algae is typically carried out in the plastid, hence most nuclear encoded proteins involved in its production will need to be efficiently targeted to the plastid. DNA sequencing and transcriptome sequencing of *Prototheca moriformis* cells revealed that all of the genes encoding the thiamine biosynthetic enzymes were present in the genome, with the exception of THIC To dissect the lesion responsible for thiamine auxotrophy at the biochemical level, the growth of *Prototheca moriformis* cells under five different regimes were examined: (1) in the presence of 2 µM thiamine hydrochloride; (2) without thiamine; (3) without thiamine, but with 2 µM hydroxyethyl thiazole (THZ); (4) without thiamine, but with 2 µM 2-methyl-4-amino-5-(aminomethyl) pyrimidine (PYR); and (5) without thiamine, but with 2 µM THZ and 2 µM PYR. Results from the growth experiments under these 5 different conditions indicated that *Prototheca moriformis* cells are capable of de novo synthesis, but can only produce thiamine pyrophosphate (TPP) if the PYR precursor is provided. This result is consistent with the hypothesis that the thiamine auxotrophy of *Prototheca moriformis* is due to the inability to synthesize hydroxymethylpyrimidine phosphate (HMP-P) from aminoimidazole ribonucleotide, which is the conversion catalyze by THIC enzyme.

*Prototheca moriformis* cells were transformed using the biolistic transformation methods described above in Example 2, expressing the *Coccomyxa* C-169 THIC (amino acid sequence corresponding to JGI Protein ID 30481, and hereby incorporated by reference) and a *S. cerevisiae* SUC2 sucrose invertase as the selective marker. This expression construct contained the native transit peptide sequence from *Coccomyxa* C-169 THIC, upstream and downstream homologous recombination targeting sequences to the 6S region of genomic DNA, a *C. reinhardtii* TUB2 promoter/5'UTR region (SEQ ID NO: 104), and a *Chlorella vulgaris* nitrate reductase 3'UTR (SEQ ID NO: 115). The *S. cerevisiae* SUC2 expression was also driven by a *C. reinhardtii* TUB2 promoter/5'UTR region (SEQ ID NO: 114) and contained a *Chlorella vulgaris* nitrate reductase 3'UTR (SEQ ID NO: 115). Genes were optimized according to the preferred codon usage in *Prototheca moriformis*. The relevant expression cassette sequences are listed in the Sequence Listing and detailed below:

| | |
|---|---|
| *Coccomyxa* C-169 THIC amino acid sequence | SEQ ID NO: 125 |
| *Coccomyxa* C-169 THIC amino acid sequence native transit peptide | SEQ ID NO: 126 |
| *Coccomyxa* C-169 THIC transformation cassette | SEQ ID NO: 127 |
| *Coccomyxa* C-169 THIC sequence (codon optimized) | SEQ ID NO: 128 |
| *S. cerevisiae* SUC2 sequence (codon optimized) | SEQ ID NO: 129 |
| 5' 6S homologous recombination targeting sequence | SEQ ID NO: 82 |
| 3' 6S homologous recombination targeting sequence | SEQ ID NO: 84 |

Selection of positive clones were performed on plates without thiamine and containing sucrose as the sole carbon source. Positive clones were confirmed using PCR with a 5' primer that binds within the *Coccomyxa* C-169 THIC gene and a 3' primer that anneals downsteam of the transforming DNA in the 6S locus. PCR confirmed positive clones were also confirmed using Southern blot assays.

To observe the thiamine auxotrophy of wildtype *Prototheca moriformis* cells, it was necessary to first deplete cells of internal thiamine reserves. To test growth in medium without thiamine, cells were first grown to stationary phase in medium containing 2 µM thiamine and then the cells were diluted to an optical density at 750 nm (OD750) of approximately 0.05 in medium without thiamine. The diluted cells were then grown once more to stationary phase in medium without thiamine (about 2-3 days). These thiamine-depleted cells were used to inoculate cultures for growth studies in medium without thiamine. Wildtype cells were grown in medium with glucose as the carbon source (with or without thiamine) and positive clones with the native transit peptide *Coccomyxa* C-169 THIC construct were grown in medium with sucrose as the sole carbon source. Growth was measured by monitoring the absorbance at 750 nm. Results of the growth experiments showed substantial greater growth in thiamine-free medium of strains expressing the transgene compared to wildtype cells in thiamine-free medium. However, the transformants failed to achieve the growth rate and cell densities of wildtype cells in thiamine-containing media. There was also a strong correlation between the amount of growth in the transformant clones in thiamine-free medium and the copy number of the integrated *Coccomyxa* enzyme (i.e., the more copy numbers of the transgene, the better the growth of the cells in thiamine-free medium).

Additional transformants were generated using expression constructs containing the *Coccomyxa* THIC, the *Arabidopsis thaliana* THIC gene, and the *Synechocystis* sp. PCC 6803 thiC gene. In the case of the *Coccomyxa* and the *A. thaliana* THIC gene, the native transit peptide sequence was replaced with the transit peptide sequence from a *Chlorella protothecoides* stearoyl-ACP desaturase (SAD) gene. *Synechocystis* sp. is a cyanobacterium and the thiC protein does not contain a native transit peptide sequence. In the *Synechocystis* sp thiC construct, the transit peptide sequence from a *Chlorella protothecoides* SAD gene was fused to the N-terminus of the *Synechocystis* sp. thiC. In all cases, the sequences were codon optimized for expression in *Prototheca moriformis*. All three of the foregoing constructs contained a upstream and downstream homologous recombination targeting sequence to the 6S region of the genome (SEQ ID NOs: 82 and 84), a *Chlorella prototheocoides* actin promoter/5' UTR, and a *Chlorella prototheocoides* EFTA gene 3'UTR. All three constructs contained a neoR gene driven by the *C. reinhardtii* TUB2 promoter/5'UTR (SEQ ID NO: 114) and contained the *C vulgaris* 3'UTR (SEQ ID NO: 115), conferring the selection by G418. The amino acid sequence of the *A. thaliana* THIC corresponded to NCBI accession number NP_180524 and the amino acid sequence of the *Synechocystis* sp. thiC corresponded to NCBI accession number NP_442586, both sequences hereby incorporated by reference. The relevant expression cassette sequences are listed in the Sequence Listing and detailed below:

| | |
|---|---|
| *Coccomyxa* THIC expression construct with *C. prototheocoides* transit peptide | SEQ ID NO: 130 |
| *Coccomyxa* THIC with *C. prototheocoides* transit peptide | SEQ ID NO: 131 |
| *C. prototheocoides* actin promoter/5' UTR | SEQ ID NO: 132 |
| *C. prototheocoides* EF1A 3'UTR | SEQ ID NO: 133 |
| *A. thaliana* THIC expression construct | SEQ ID NO: 134 |
| *A. thaliana* THIC with *C. prototheocoides* transit peptide | SEQ ID NO: 135 |
| *A. thaliana* THIC amino acid sequence with native transit peptide | SEQ ID NO: 136 |
| *Synechocystis* sp. thiC expression construct | SEQ ID NO: 137 |
| *Synechocystis* sp. thiC with *C. prototheocoides* transit peptide | SEQ ID NO: 138 |
| *Synechocystis* sp. thiC amino acid sequence | SEQ ID NO: 139 |
| neoR gene | SEQ ID NO: 140 |

Positive clones were screened on plates containing G418 and several clones from each transformation were picked for verification by PCR. Integration of the transforming DNA constructs containing the *Coccomyxa* C-169 (with *C prototheocoides* transit peptide), *A. thaliana* and *Synechocystis* sp. PCC 6803 THIC genes, respectively into the 6S locus of the genome was confirmed using PCR analysis with the following primers:

```
5' THIC Coccomyxa confirmation primer sequence
                                    (SEQ ID NO: 141)
ACGTCGCGACCCATGCTTCC 3' THIC confirmation primer sequence
                                    (SEQ ID NO: 142)
GGGTGATCGCCTACAAGA 5' THIC A. thaliana confirmation primer sequence
                                    (SEQ ID NO: 143)
GCGTCATCGCCTACAAGA 5' thiC Synechocystis sp. confirmation primer
sequence
                                    (SEQ ID NO: 144)
CGATGCTGTGCTACGTGA
```

Growth experiments on thiamine depleted cells (as described above) were performed using selected confirmed positive clones from transformants of each of the different constructs in medium containing G418. All transformants were able to grow (with varying degrees of robustness) in thiamine-free medium. Comparison of the growth of the transformants in thiamine-free medium to wild type cells on thiamine-containing medium showed the following ranking with respect to their ability to support growth in thiamine-free medium: (1) *A. thaliana* transformants; (2) *Coccomyxa* C-169 (with *C. prototheocoides* transit peptide) transformants; and (3) *Synechocystis* sp. transformants. These results suggest that while a single copy of *A. thaliana* THIC was able to complement thiamine auxotrophy in *Prototheca moriformis* cells, multiple copies of *Coccomyxa* C-169 (with either the native transit peptide sequence or a transit peptide sequence from *C. prototheocoides*) and *Synechocystis* sp. THIC was required to enable rapid growth in the absence of thiamine. Given the variability in results of the different THIC from the different sources, the ability of any particular THIC gene to fully complement the lesion present in *Prototheca* species is not predictable.

An alignment of the three THIC amino acid sequences was performed. While there exist significant sequence conservation between thiC from *Synechocystis* sp. compared to the THICs from *Coccomyxa* and *A. thaliana* (41% identity at the amino acid level), the cyanobacterial protein is missing a domain at the N-terminus that is well-conserved in the algal and plant proteins. Despite the missing domain (and presumably resulting in structural differences), the construct expressing the *Synechocystis* sp. thiC was able to at least partially restore thiamine prototrophic in *Prototheca moriformis* cells.

Example 13

Fuel Production

A. Extraction of Oil from Microalgae Using an Expeller Press and a Press Aid

Microalgal biomass containing 38% oil by DCW was dried using a drum dryer resulting in resulting moisture content of 5-5.5%. The biomass was fed into a French L250 press. 30.4 kg (67 lbs.) of biomass was fed through the press and no oil was recovered. The same dried microbial biomass combined with varying percentage of switchgrass as a press aid was fed through the press. The combination of dried microbial biomass and 20% w/w switchgrass yielded the best overall percentage oil recovery. The pressed cakes were then subjected to hexane extraction and the final yield for the 20% switchgrass condition was 61.6% of the total available oil (calculated by weight). Biomass with above 50% oil dry cell weight did not require the use of a pressing aid such as switchgrass in order to liberate oil. Other methods of extraction of oil from microalgae using an expeller press are described in PCT Application No. PCT/US2010/31108 and is hereby incorporated by reference.

B. Production of Biodiesel from *Prototheca* Oil

Degummed oil from *Prototheca moriformis* UTEX 1435, produced according to the methods described above, was subjected to transesterification to produce fatty acid methyl esters. Results are shown in Table 24 below.

The lipid profile of the oil was:
C10:0 0.02
C12:0 0.06
C14:0 1.81
C14:1 0.07
C16:0 24.53
C16:1 1.22
C18:0 2.34
C18:1 59.21
C18:2 8.91
C18:3 0.28
C20:0 0.23
C20:1 0.10
C20:1 0.08
C21:0 0.02
C22:0 0.06
C24:0 0.10

TABLE 24

Biodiesel profile from *Prototheca moriformis* triglyceride oil.

| Method | Test | | Result | Units |
|---|---|---|---|---|
| ASTM D6751 A1 | Cold Soak Filterability of Biodiesel Blend Fuels | Filtration Time | 120 | sec |
| | | Volume Filtered | 300 | ml |
| ASTM D93 | Pensky-Martens Closed Cup Flash Point | Procedure Used | A | |
| | | Corrected Flash Point | 165.0 | °C. |
| ASTM D2709 | Water and Sediment in Middle Distillate Fuels (Centrifuge Method) | Sediment and Water | 0.000 | Vol % |
| EN 14538 | Determination of Ca and Mg Content by ICP OES | Sum of (Ca and Mg) | <1 | mg/kg |
| EN 14538 | Determination of Ca and Mg Content by ICP OES | Sum of (Na and K) | <1 | mg/kg |
| ASTM D445 | Kinematic/Dynamic Viscosity | Kinematic Viscosity @ 104° F./40° C. | 4.873 | $mm^2/s$ |
| ASTM D874 | Sulfated Ash from Lubricating Oils and Additives | Sulfated Ash | <0.005 | Wt % |
| ASTM D5453 | Determination of Total Sulfur in Light Hydrocarbons, Spark Ignition Engine Fuel, Diesel Engine Fuel, and Engine Oil by Ultraviolet Fluorescence. | Sulfur, mg/kg | 1.7 | mg/kg |
| ASTM D130 | Corrosion - Copper Strip | Biodiesel-Cu Corrosion 50° C. (122° F.)/3 hr | 1a | |
| ASTM D2500 | Cloud Point | Cloud Point | 6 | °C. |
| ASTM D4530 | Micro Carbon Residue | Average Micro Method Carbon Residue | <0.10 | Wt % |
| ASTM D664 | Acid Number of Petroleum Products by Potentiometric Titration | Procedure Used | A | |
| | | Acid Number | 0.20 | mg KOH/g |
| ASTM D6584 | Determination of Free and Total Glycerin in B-100 Biodiesel Methyl Esters By Gas Chromatography | Free Glycerin | <0.005 | Wt % |
| | | Total Glycerin | 0.123 | Wt % |
| ASTM D4951 | Additive Elements in Lubricating Oils by ICP-AES | Phosphorus | 0.000200 | Wt % |
| ASTM D1160 | Distillation of Petroleum Products at Reduced Pressure | IBP | 248 | °C. |
| | | AET @ 5% Recovery | 336 | °C. |
| | | AET @ 10% Recovery | 338 | °C. |
| | | AET @ 20% Recovery | 339 | °C. |
| | | AET @ 30% Recovery | 340 | °C. |
| | | AET @ 40% Recovery | 342 | °C. |
| | | AET @ 50% Recovery | 344 | °C. |
| | | AET @ 60% Recovery | 345 | °C. |
| | | AET @ 70% Recovery | 347 | °C. |
| | | AET @ 80% Recovery | 349 | °C. |
| | | AET @ 90% Recovery | 351 | °C. |
| | | AET @ 95% Recovery | 353 | °C. |
| | | FBP | 362 | °C. |
| | | % Recovered | 98.5 | % |
| | | % Loss | 1.5 | % |
| | | % Residue | 0.0 | % |
| | | Cold Trap Volume | 0.0 | ml |
| | | IBP | 248 | °C. |
| EN 14112 | Determination of Oxidation Stability (Accelerated Oxidation Test) | Oxidation Stability | >12 | hr |
| | | Operating Temp (usually 110 deg C.) | 110 | °C. |
| ASTM D4052 | Density of Liquids by Digital Density Meter | API Gravity @ 60° F. | 29.5 | °API |
| ASTM D6890 | Determination of Ignition Delay (ID) and Derived Cetane Number (DCN) | Derived Cetane Number (DCN) | >61.0 | |

The lipid profile of the biodiesel was highly similar to the lipid profile of the feedstock oil. Other oils provided by the methods and compositions of the invention can be subjected to transesterification to yield biodiesel with lipid profiles including (a) at least 4% C8-C14; (b) at least 0.3% C8; (c) at least 2% C10; (d) at least 2% C12; and (3) at least 30% C8-C14.

The Cold Soak Filterability by the ASTM D6751 A1 method of the biodiesel produced was 120 seconds for a volume of 300 ml. This test involves filtration of 300 ml of B 100, chilled to 40° F. for 16 hours, allowed to warm to room temp, and filtered under vacuum using 0.7 micron glass fiber filter with stainless steel support. Oils of the invention can be transesterified to generate biodiesel with a cold soak time of less than 120 seconds, less than 100 seconds, and less than 90 seconds.

C Production of Renewable Diesel

Degummed oil from *Prototheca moriformis* UTEX 1435, produced according to the methods described above and having the same lipid profile as the oil used to make biodiesel in this Example, above, was subjected to transesterification to produce renewable diesel.

The oil was first hydrotreated to remove oxygen and the glycerol backbone, yielding n-paraffins. The n-parraffins were then subjected to cracking and isomerization. A chromatogram of the material is shown in FIG. 1. The material was then subjected to cold filtration, which removed about 5% of the C18 material. Following the cold filtration the total volume material was cut to flash point and evaluated for flash point, ASTM D-86 distillation distribution, cloud point and viscosity. Flash point was 63° C; viscosity was 2.86 cSt (centistokes); cloud point was 4° C. ASTM D86 distillation values are shown in Table 25:

TABLE 25

| ASTM D86 distillation values. Readings in ° C.: | |
|---|---|
| Volume | Temperature |
| IBP | 173 |
| 5 | 217.4 |
| 10 | 242.1 |
| 15 | 255.8 |
| 20 | 265.6 |
| 30 | 277.3 |
| 40 | 283.5 |
| 50 | 286.6 |
| 60 | 289.4 |
| 70 | 290.9 |
| 80 | 294.3 |
| 90 | 300 |
| 95 | 307.7 |
| FBP | 331.5 |

The T10-T90 of the material produced was 57.9° C Methods of hydrotreating, isomerization, and other covalent modification of oils disclosed herein, as well as methods of distillation and fractionation (such as cold filtration) disclosed herein, can be employed to generate renewable diesel compositions with other T10-T90 ranges, such as 20, 25, 30, 35, 40, 45, 50, 60 and 65° C using triglyceride oils produced according to the methods disclosed herein.

The T10 of the material produced was 242.1° C. Methods of hydrotreating, isomerization, and other covalent modification of oils disclosed herein, as well as methods of distillation and fractionation (such as cold filtration) disclosed herein, can be employed to generate renewable diesel compositions with other T10 values, such as T10 between 180 and 295, between 190 and 270, between 210 and 250, between 225 and 245, and at least 290.

The T90 of the material produced was 300° C. Methods of hydrotreating, isomerization, and other covalent modification of oils disclosed herein, as well as methods of distillation and fractionation (such as cold filtration) disclosed herein can be employed to generate renewable diesel compositions with other T90 values, such as T90 between 280 and 380, between 290 and 360, between 300 and 350, between 310 and 340, and at least 290.

The FBP of the material produced was 300° C. Methods of hydrotreating, isomerization, and other covalent modification of oils disclosed herein, as well as methods of distillation and fractionation (such as cold filtration) disclosed herein, can be employed to generate renewable diesel compositions with other FBP values, such as FBP between 290 and 400, between 300 and 385, between 310 and 370, between 315 and 360, and at least 300.

Other oils provided by the methods and compositions of the invention can be subjected to combinations of hydrotreating, isomerization, and other covalent modification including oils with lipid profiles including (a) at least 4% C8-C14; (b) at least 0.3% C8; (c) at least 2% C10; (d) at least 2% C12; and (3) at least 30% C8-C14.

Example 14

Production of Tailored Oils

Using the methods and materials as disclosed herein, various tailored oils were produced. Table 32 shows the strain, the gene and the genbank accession numbers of the genes conferring the phenotype and the various fatty acid profiles produced by the indicated strain. Strains A and B are both *Prototheca moriformis* (UTEX 1435) strains, both of which were classically mutagenized by a fee-for-service laboratory to improve oil yield. Strains A and B were then genetically engineered as described herein with the appropriate DNA constructs to express the desired genes. The strains were also engineered to inactivate endogenous desaturases, as indicated. The nucleotide sequences of the thioesterases were codon optimized for expression and use in *Prototheca*.

The fatty acid profile of wild type, un-engineered *Prototheca* is shown in the first line of Table 32. As can be seen, the fatty acid profile has been dramatically altered in different ways in the different strains. For example, the percentage of C8:0 produced by non-genetically engineered *P. moriformis* cells is 0%. However, *P. moriformis* cells engineered to express a *C. hookeriana* thioesterase increased C8:0 production from 0% to 13.2% of the total triglycerides. As another example, the total combined amount of C8:0 and C10:0 in the engineered strains was about 39% of the total fatty acids. In contrast, the total combined amount of C8:0 and C10:0 in the wild type cells is 0.01%. In another example, the total amount of saturated fatty acids was increased from about 32% to about 90% by the expression of an *U. americana* thioesterase in cells in which expression of endogenous SAD2b was disrupted. This is an increase of almost 300%.

The various fatty acid profiles as disclosed below are useful in myriad applications involving triglyceride oils. For example, high levels of lower carbon chain length saturated fatty acids comprising triglyceride (C12:0, C14:0, C16:0) are particularly useful in renewable jet fuel production. For biodiesel production, high amounts of C18:1 are desirable. For bar soap production, controlling and achieving the appropriate balance between the levels of saturation and shorter chain fatty acids is desirable. As an example, high amounts of C12:0 are desirable for lathering properties while longer chain lengths provide more structure, while linoleic and linolenic containing triglycerides are less desirable as they contribute to oxidative instability. For liquid soaps, high amounts of C12:0 and C14:0 are desirable. Additionally, for both bar soap and liquid soap production, low amounts of C6:0, C8:0 and C10:0 are desirable as these lower chain triglycerides are skin irritants.

TABLE 25A

Genes and accession numbers conferring phenotypes of various triglyceride profiles.

| Trait | Gen Bank Accession and Descriptoin | Gene Conferring Phenotype | Construct* | Seq. Id. No. | Strain Genetic Background | C8:0 | C10:0 | C12:0 | C14:0 | C16:0 | C18:0 | C18:1 | C18:2 | Total Saturates |
|---|---|---|---|---|---|---|---|---|---|---|---|---|---|---|
| Wild Type | | | na | | UTEX 1435 | 0.00 | 0.01 | 0.04 | 1.27 | 27.20 | 3.85 | 58.70 | 7.18 | 32.36 |
| Highest C8 | U39834 | *C. hookeriana* TE | pSZ 1458 | | A | 13.20 | 25.84 | 0.51 | 1.41 | 10.22 | 1.39 | 38.21 | 7.42 | 52.57 |
| Highest C10 | U39834 | *C. hookeriana* TE | pSZ 1458 | | A | 13.20 | 25.84 | 0.51 | 1.41 | 10.22 | 1.39 | 38.21 | 7.42 | 52.57 |
| Highest C12 | U56104 and U67317 (SEQ ID NO: 185) | *C. wrightii* TE + *C. wrightii* KASA1 | pSZ 1491 (SEQ ID NO: 232) | | B | .02 | 13.63 | 50.59 | 6.49 | 6.64 | 0.87 | 13.74 | 6.83 | 78.00 |
| Highest C14 | U31813 | *Cinnamomum camphora* TE | pSZ 941 (SEQ ID NO: 236)/944 (SEQ ID NO: 228) | | UTEX 1435 | 0.00 | 0.06 | 5.91 | 43.27 | 19.63 | 0.87 | 13.96 | 13.78 | 69.74 |
| Highest C16 | Q39513.1 | *C. hookeriana* TE | pSZ 1417 (SEQ ID NO: 226) | | A | 0.00 | 0.02 | 0.11 | 10.62 | 69.92 | 2.18 | 12.95 | 5.15 | 80.35 |
| Highest C18 | U56104 as SAD2B gene disruption | *C. wrightii* TE | pSZ 1410 (SEQ ID NO: 230) | | A | 0.00 | 0.11 | 1.28 | 1.82 | 24.55 | 37.38 | 23.51 | 7.88 | 65.14 |
| Highest C8-C10 | U39834 | *C. hookeriana* TE | pSZ 1458 | | A | 13.20 | 25.84 | 0.51 | 1.41 | 10.22 | 1.39 | 38.21 | 7.42 | 52.57 |
| Highest C8-C14 | U56104 | *C. wrightii* TE | pSZ 1283 (SEQ ID NO: 229) | | A | .22 | 17.64 | 45.85 | 10.94 | 5.55 | 0.79 | 13.49 | 4.68 | 74.65 |
| Highest C10-C14 | U56104 | *C. wrightii* TE | pSZ 1283 (SEQ ID NO: 229) | | A | .22 | 17.64 | 45.85 | 10.94 | 5.55 | 0.79 | 13.49 | 4.68 | 74.65 |
| Highest C12-C14 | ABB71579.1 (SEQ ID NO: 286) | *C. callophylla* TE | pSZ 1570 (SEQ ID NO: 235) | | B | .01 | 0.88 | 28.04 | 34.08 | 19.82 | 1.00 | 10.52 | 4.42 | 83.83 |
| Lowest 18:1 | AAB71731 (SEQ ID NO: 287) as SAD2B gene disruption | *Ulmus americana* TE | pSZ 1321 (SEQ ID NO: 242) | | A | .12 | 10.39 | 3.55 | 35.21 | 33.54 | 4.90 | 5.15 | 5.69 | 87.71 |
| Highest 18:1 | FADc Disruption with *Carthamus tincorus*TE AAA33019.1 | *Carthamus tinctorus* TE | pSZ 1500 (SEQ ID NO: 233) | | A | 0 | 0 | 0 | 0 | 16.49 | 0 | 83.51 | 0.00 | 16.49 |
| Lowest 18:2 | FADc Disruption with *Carthamus tincorus*TE AAA33019.1 | *Carthamus tinctorus* TE | pSZ 1501 (SEQ ID NO: 234) | | A | 0 | 0 | .03 | 1.05 | 18.01 | 1.44 | 77.11 | 0.00 | 20.53 |
| Highest Saturates | AAB71731 as a SAD2B Disruption | *Ulmus americana* TE | pSZ 1321 (SEQ ID NO: 242) | | A | .30 | 13.07 | 3.57 | 33.58 | 33.52 | 5.16 | 5.36 | 4.50 | 89.20 |

Palm Kernel Oil

We produced a microbial palm kernel oil mimetic that was similar to palm kernel oil (PKO). To produce the palm kernel oil mimetic, a plasmid was constructed and used to transform Strain A and oil production was carried out. The construct, pSZ1413 (SEQ ID NO: 231), comprised codon optimized *Cuphea wrightii* FATB2 gene (SEQ ID NO: 284) (Gen bank accession no. U56106) and SAD2B (stearoyl ACP desaturase) gene disruption.

As shown in Table 25B below, the palm kernel oil mimetic was similar to palm kernel oil. The percentages of the three most abundant fatty acids of the PKO mimetic (C12:0, C14:0 and C18:1) were identical to or within 10% of the palm kernel oil.

TABLE 25B

| Triglyceride profile of palm kernel oil mimetic. | | | | | | | | |
|---|---|---|---|---|---|---|---|---|
| | C8:0 | C10:0 | C12:0 | C14:0 | C16:0 | C18:0 | C18:1 | C18:2 |
| *E. guineensis* (Palm kernel) | 3.0-5.0 | 2.5-6.0 | 40-52 | 14.0-18.0 | 7.0-10.0 | 1.0-3.0 | 11.0-19.0 | 0.5-4.0 |
| pSZ1413 | | 8.33 | 37.45 | 18.22 | 13.52 | 1.25 | 15.29 | 4.95 |

Palm Oil

We produced a microbial palm oil mimetic that was similar to palm oil. Several different plasmids were constructed and transformed individually into Strain A and oil production was carried out. The construct, pSZ1503 (SEQ ID NO: 283), was designed to disrupt an endogenous KASII gene. The construct, pSZ1439 (SEQ ID NO: 237), comprised a codon optimized *Elaeis guiniensis* TE gene (SEQ ID NO: 205) (Gen bank accession no. AAD42220.2). The construct, pSZ1420 (SEQ ID NO: 225), comprised a codon optimized *Cuphea hookeriana* TE gene (SEQ ID NO: 201) (Gen Bank Accession no. Q39513). The construct, pSZ1119 (SEQ ID NO: 227), comprised a codon optimized *Cuphea hookeriana* KAS IV gene (SEQ ID NO: 186) (Gen Bank Accession no. AF060519) as well as a *Cuphea wrightii* FATB2 gene (SEQ ID NO: 184) (Gen Bank Accession no. U56104).

As shown in Table 25C below, the palm oil mimetic was similar to palm oil. The percentages of the three most abundant fatty acids of the palm oil mimetic (C16:0, C18:1 and C18:2) were identical to or within 10% of palm oil.

TABLE 25C

| Triglyceride profile of palm oil mimetic. | | | | | | | |
|---|---|---|---|---|---|---|---|
| | C10:0 | C12:0 | C14:0 | C16:0 | C18:0 | C18:1 | C18:2 |
| *E. guineensis* (Palm) | 0 | 0 | 0.5-5.9 | 32.0-47.0 | 2.0-8.0 | 34-44 | 7.2-12.0 |
| pSZ1503 | 0.01 | 0.01 | 0.83 | 38.36 | 2.21 | 48.31 | 7.60 |
| pSZ1439 | 0.01 | 0.04 | 1.88 | 43.50 | 3.32 | 39.95 | 9.16 |
| pSZ1420 | 0.02 | 0.04 | 2.44 | 48.04 | 2.76 | 35.62 | 8.91 |
| pSZ1119 | 1.77 | 0.40 | 7.85 | 35.45 | 2.47 | 42.85 | 8.15 |

Cocoa Butter

We produced a microbial cocoa butter mimetic that was similar to cocoa butter. The construct, pSZ1451, was constructed and transformed into Strain A and oil production was carried out. The construct, pSZ1451 (SEQ ID NO: 239), comprised codon optimized *Carthamus tinctorus* TE gene (SEQ ID NO: 187) (Gen Bank Accession no. AAA33019.1).

As shown in Table 25D below, the cocoa butter oil mimetic was similar to cocoa butter. The percentages of the three most abundant fatty acids of the cocoa butter mimetic (C16:0, C18:0 and C18:1) were identical to or within 10% of cocoa butter.

TABLE 25D

| Triglyceride profile of cocoa butter mimetic. | | | | | | | | |
|---|---|---|---|---|---|---|---|---|
| | C8:0 | C10:0 | C12:0 | C14:0 | C16:0 | C18:0 | C18:1 | C18:2 |
| Cocoa Butter | 0 | 0-1 | 0-1 | 0-4 | 22-38 | 24-37 | 29-38 | 0-3 |
| pSZ1451 | | 0.05 | 0.14 | 0.99 | 28.34 | 27.39 | 29.40 | 10.26 |

Lard

We produced a microbial lard mimetic that was similar to lard. Several different plasmids were constructed and transformed individually into Strain A and oil production was carried out. The construct, pSZ1493 (SEQ ID NO: 241), was designed to disrupt the endogenous SAD 2B gene and simultaneously express a codon optimized Umbellularia californica TE gene (SEQ ID NO: 285) (Gen Bank Accession no. M94159). The construct, pSZ1452 (SEQ ID NO: 240), was designed to disrupt the endogenous SAD 2B gene and express a codon optimized *Garcinia mangostana* TE gene (SEQ ID NO: 196) (Gen Bank Accession no. AAB51525.1). The construct, pSZ1449 (SEQ ID NO: 238), was designed to express the codon optimized *Brassica napus* TE gene (SEQ ID NO: 195) (Gen Bank Accession no. CAA52070.1). The polynucleotide sequence of the construct pSZ1458 was identical to pSZ1449 except that a codon optimized polynucleotide sequence encoding a *Cuphea hookeriana* thioesterase (Gen Bank accession No. U39834) replaced the polynucleotide sequence encoding *Brassica napus* TE gene (SEQ ID NO: 195) (Gen Bank Accession no. CAA52070.1).

As shown in Table 25E below, the lard mimetic was similar to lard. The percentages of the three most abundant fatty acids of the lard mimetic (C16:0, C18:0 and C18:1) were identical to or within 10% of lard.

TABLE 25E

Triglyceride profile of lard mimetic.

|  | C14:0 | C16:0 | C18:0 | C18:1 | C18:2 |
| --- | --- | --- | --- | --- | --- |
| Lard | 3-4 | 22-26 | 13-18 | 39-45 | 8-15 |
| pSZ1493 | 1.32 | 24.79 | 17.49 | 41.87 | 10.01 |
| pSZ1452 | 1.16 | 24.49 | 17.94 | 45.49 | 8.05 |
| pSZ1449 | 1.16 | 23.98 | 15.79 | 47.88 | 8.29 |

Although this invention has been described in connection with specific embodiments thereof, it will be understood that it is capable of further modifications. This application is intended to cover any variations, uses, or adaptations of the invention following, in general, the principles of the invention and including such departures from the present disclosure as come within known or customary practice within the art to which the invention pertains and as may be applied to the essential features hereinbefore set forth.

All references cited herein, including patents, patent applications, and publications, including Genbank Accession numbers, are hereby incorporated by reference in their entireties, whether previously specifically incorporated or not. The publications mentioned herein are cited for the purpose of describing and disclosing reagents, methodologies and concepts that may be used in connection with the present invention. Nothing herein is to be construed as an admission that these references are prior art in relation to the inventions described herein. In particular, the following patent applications are hereby incorporated by reference in their entireties for all purposes: PCT Application No. PCT/US2008/065563, filed Jun. 2, 2008, entitled "Production of Oil in Microorganisms", PCT Application No. PCT/US2010/31108, filed Apr. 14, 2010, entitled "Methods of Microbial Oil Extraction and Separation", and PCT Application No. PCT/US2009/066142, filed Nov. 30, 2009, entitled "Production of Tailored Oils in Heterotrophic Microorganisms".

SEQUENCE LISTING (287 sequences)

SEQ ID NO: 1 - DNA, 1187 bp, Unknown
  Chlorella species
gatcagacgggcctgacctgcgagataatcaagtgctcgtaggcaaccaactcagcagctgcttggtgttgggtctgcaggatagtgttgcagggccccaaggacagcaggggaacttacaccttgtccccgacccagttttatggagtgcattgcctcaagagcctagccggagcgctaggctacatacttgccgcaccggtatgaggggatatagtactcgcactgcgctgtctagtgagatgggcagtgctgcccataaacaactggctgctcagccatttgttggcggaccattctgggggggccagcaatgcctgactttcgggtagggtgaaaactgaacaaagactaccaaaacagaatttcttcctccttggaggtaagcgcaggccggcccgcctgcgcccacatggcgctccgaacacctccatagctgtaagggcgcaaacatggccggactgttgtcagcactctttcatggccatacaaggtcatgtcgagattagtgctgagtaagacactatcaccccatgttcgattgaagccgtgacttcatgccaacctgcccctgggcgtagcagacgtatgccatcatgaccactagccgacatgcgctgtcttttgccaccaaaacaactggtacaccgctcgaagtcgtgccgcacacctccgggagtgagtccggcgactcctccccggcgggccgcggccctacctgggtagggtcgccatacgcccacgaccaaacgacgcaggaggggattggggtagggaatcccaaccagcctaaccaagacggcacctataataataggtggggggactaacagccctatatcgcaagctttgggtgcctatcttgagaagcacgagttggagtggctgtgtacggtcgaccctaaggtgggtgtgccgcagcctgaaacaaagcgtctagcagctgcttctataatgtgtcagccgttgtgtttcagttatattgtatgctattgtttgttcgtgctagggtggcgcaggcccacctactgtggcgggccattggttggtgcttgaattgcctcaccatctaaggtctgaacgctcactcaaacgcctttgtacaactgcagaactttccttggcgctgcaactacagtgtgcaaaccagcacatagcactcccttacatcacccagcagtacaaca

SEQ ID NO: 2 - DNA, 1414 bp, Chlorella ellipsoidea
cgctgcgcaccagggccgccagctcgctgatgtcgctccaaatgcggtcccccgattttttgttcttcatcttctccaccttggtggccttcttggccagggccttcagctgcatgcgcacagaccgttgagctcctgatcagcatcctcaggaggccctttgacaagcaagcccctgtgcaagcccattcacggggtaccagtggtgctgaggtagatgggtttgaaaaggattgctcggtcgattgctgctcatggaattggcatgtgcatgcatgttcacaatatgccaccaggctttggagcaagagagcatgaatgccttcaggcaggttgaaagttcctgggggtgaagaggcagggccgaggattggaggaggaaagcatcaagtcgtcgctcatgctcatgttttcagtcagagtttgccaagctcacaggagcagagacaagactggctgctcaggtgttgcatcgtgtgtgtggtgggggggggggggttaatacggtacgaaatgcacttggaattcccacctcatgccagcggacccacatgcttgaattcgaggcctgtggggtgagaaatgctcactctgccctcgttgctgaggtacttcaggccgctgagctcaaagtcgatgccctgctcgtctatcagggcctgcacctctgggctgaccggctcagcctccttcgcgggcatggagtaggcgccggcagcgttcatgtccgggcccagggcagcggtggtgccataaatgtcggtgatggtggggaggggggccgtcgccacaccattgccgttgctggctgacgcatgcacatgtggcctggctggcaccggcagcactggtctccagccagccagcaagtggctgttcaggaaagcggccatgttgttggtccctgcgcatgtaattccccagatcaaaggagggaacagcttggatttgatgtagtgcccaaccggactgaatgtgcgatggcaggtccctttgagtctcccgaattactagcagggcactgtgacctaacgcagcatgccaaccgcaaaaaaatgattgacagaaaatgaagcggtgtgtcaatatttgctgtatttattcgttttaatcagcaaccaagttcgaaacgcaactatcgtggtgatcaagtgaacctcatcagacttacctcgttcggcaaggaaacggaggcaccaaattccaatttgatattatcgcttgccaagctagagctgatctttgggaaaccaactgccagacagtggactgtgatggagtgccccgagtggtggagcctcttcgattcggttagtcattactaacgtgaaccctcagtgaagggaccatcagaccagaaagaccagatctcctcctcgacaccgagagagtgttgcggcagtaggacgacaag

SEQ ID NO: 3 - protein, 512 aa, Unknown
  Yeast sequence
MTNETSDRPLVHFTPNKGWMNDPNGLWYDEKDAKWHLYFQYNPNDTVWGTPLFWGHATSDDLTNWEDQPIAIAPKRNDSGAFSGSMVVDYNNTSGFFNDTIDPRQRCVAIWTYNTPESEEQYISYSLDGGYTFTEYQKNPVLAANSTQFRDPKVFWYEPSQKWIMTAAKSQDYKIEIYSSDDLKSWKLESAFANEGFLGYQYECPGLIEVPTEQDPSKSYWVMFISINPGAPAGGSFNQYFVGSFNGTHFEAFDNQSRVVDFGKDYYALQTFFNTDPTYGSALGIAWASNWEYSAFVPTNPWRSSMSLVRKFSLNTEYQANPETELINLKAEPILNISNAGPWSRFATNTTLTKANSYNVDLSNSTGTLEFELVYAVNTTQTISKSVFADLSLWFKGLEDPEEYLRMGFEVSASSFFLDRGNSKVKFVKENPYFTNRMSVNNQPFKSENDLSYYKVYGLLDQNILELYFNDGDVVSTNTYFMTTGNALGSVNMTTGVDNLFYIDKFQVREVK

SEQ ID NO: 4 - protein, 20 aa, Unknown
  Yeast sequence
MLLQAFLFLLAGFAAKISAS

SEQ ID NO: 5 - protein, 18 aa, Unknown
  source organism never identified, higher plants secretion signal
MANKSLLLLLLLGSLASG

SEQ ID NO: 6 - protein, 10 aa, Artificial Sequence
  source organism never identified
MARLPLAALG

SEQ ID NO: 7 - protein, 20 aa, Unknown
  source organism never identified
MANKLLLLLLLLLLPLAASG

SEQ ID NO: 8 - DNA, 2615 bp, Saccharomyces cerevisiae
gaattccccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctctggcgcgccatatcaatgcttcttcaggcctttctttttcttcttgctggttttgctgccaagatcagcgcctctatgacgaacgaaacctcggatagaccacttgtgcactttacaccaaacaagggctggatgaatgaccccaatggactgtggtacgacgaaaaagatgccaagtggcatctgtactttcaatacaacccgaacgatactgtctgggggacgccattgttttggggccacgccacgtccgacgacctgaccaattgggaggaccaaccaatagctatcgctccgaagaggaacgactccggagcattctcgggttccatggtggttgactacaacaatacttccggctttttcaacgataccattgacccgagacaacgctgcgtggccatatggacttacaacacaccggagtccgaggagcagtacatctcgtatagcctggacggtggatacacttttacagagtatcagaagaaccctgtgcttgctgcaaattcgactcagttccgagatccgaaggtcttttggtacgagccctcgcagaagtggatcatgacagcggcaaagtcacaggactacaagatcgaaatttactcgtctgacgaccttaaatcctggaagctcgaatccgcgttcgcaaacgagggctttctcggctaccaatacgaatgcccaggcctgatagaggtcccaacagagcaagatcccagcaagtcctactgggtgatgtttatttccattaatccaggagcaccggcaggaggttcttttaatcagtacttcgtcggaagctttaacggaactcatttcgaggcatttgataaccaatcaagagtagttgattttggaaaggactactatgccctgcagactttcttcaatactgacccgacctatgggagcgctcttggcattgcgtgggcttctaactgggagtattccgcattcgttcctacaaacccttggaggtcctccatgtcgctcgtgaggaaattctctctcaacactgagtaccaggccaacccggaaaccgaactcataaacctgaaagccgaaccgatcctgaacattagcaacgctggcccctggagccggtttgcaaccaacaccacgttgacgaaagccaacagctacaacgtcgatctttcgaatagcaccggtacacttgaatttgaactggtgtatgccgtcaataccacccaaacgatctcgaagtcggtgttcgcggacctctccctctggtttaaaggcctggaagaccccgaggagtacctcagaatgggtttcgaggtttctgcgtcctccttcttccttgatcgcgggaacagcaaagtaaaatttgttaaggagaacccatattttaccaacaggatgagcgttaacaaccaaccattcaagagcgaaaacgacctgtcgtactacaaagtgtatggtttgcttgatcaaaatatcctggaactctacttcaacgatggtgatgtcgtgtccaccaacacatacttcatgacaaccgggaacgcactgggctccgtgaacatgacgacgggtgtggataacctgttctacatcgacaaattccaggtgagggaagtcaagtgagatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaa

SEQ ID NO: 9 - DNA, 22 bp, Prototheca moriformis
tgttgaagaatgagccggcgac

SEQ ID NO: 10 - DNA, 20 bp, Prototheca moriformis
cagtgagctattacgcactc

SEQ ID NO: 11 - DNA, 541 bp, Prototheca kruegani
tgttgaagaatgagccggcgagttaaaaagagtggcatggttaaagaaaatactctggagccatagcgaaagcaagtttagtaagcttaggtcattctttttagacccgaaaccgagtgatctacccatgatcagggtgaagtgttagtaaaataacatggaggcccgaaccgactaatgttgaaaaattagcggatgaattgtgggtaggggcgaaaaaccaatcgaactcggagttagctggttctccccgaaatgcgtttaggcgcagcagtagcagtacaaatagaggggtaaagcactgtttcttttgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggatgtgggtatgtcaaaacctccagcaggttagcttagaagcagcaatcctttcaagagtgcgtaatagctcactg

SEQ ID NO: 12 - DNA, 573 bp, Prototheca wickerhamii
tgttgaagaatgagccggcgacttaaaataaatggcaggctaagagatttaataactcgaaacctaagcgaaagcaagtcttaatagggcgtcaatttaacaaaactttaaataaattataaagtcatttattttagacccgaacctgagtgatctaaccatggtcaggatgaaacttgggtgacaccaagtggaagtccgaaccgaccgatgttgaaaaatcggcggatgaactgtggttagtggtgaaataccagtcgaactcagagctagctggttctccccgaaatgcgttgaggcgcagcaatatatctcgtctatctaggggtaaagcactgtttcggtgcgggctatgaaaatggtaccaaatcgtggcaaactctgaatactagaaatgacgatatattagtgagactatgggggataagctccatagtcgagagggaaacagcccagaccaccagttaaggccccaaaatgataatgaagtggtaaaggaggtgaaaatgcaaatacaaccaggaggttggcttagaagcagccatcctttaaagagtgcgtaatagctcactg

SEQ ID NO: 13 - DNA, 541 bp, Prototheca stagnora
tgttgaagaatgagccggcgagttaaaaaaaatggcatggttaaagatatttctctgaagccatagcgaaagcaagttttacaagctatagtcattttttttagacccgaaaccgagtgatctacccatgatcagggtgaagtgttggtcaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttcttttgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggacgtgagtatgtcaaaacctccagcaggttagcttagaagcagcaatcctttcaagagtgcgtaatagctcactg

SEQ ID NO: 14 - DNA, 541 bp, Prototheca moriformis
tgttgaagaatgagccggcgagttaaaaagagtggcatggttaaagataattctctggagccatagcgaaagcaagtttaacaagctaaagtcaccctttttagacccgaaaccgagtgatctacccatgatcagggtgaagtgttggtaaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttcttttgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggatgtgggtatgttaaaacctccagcaggttagcttagaagcagcaatcctttcaagagtgcgtaatagctcactg

SEQ ID NO: 15 - DNA, 573 bp, Prototheca moriformis
tgttgaagaatgagccggcgacttaaaataaatggcaggctaagagaattaataactcgaaacctaagcgaaagcaagtcttaatagggcgctaatttaacaaaacattaaataaaatctaaagtcatttattttagacccgaacctgagtgatctaaccatggtcaggatgaaacttgggtgacaccaagtggaagtccgaaccgaccgatgttgaaaaatcggcggatgaactgtggttagtggtgaaataccagtcgaactcagagctagctggttctccccgaaatgcgttgaggcgcagcaatatatctcgtctatctaggggtaaagcactgtttcggtgcgggctatgaaaatggtaccaaatcgtggcaaactctgaatactagaaatgacgatatattagtgagactatgggggataagctccatagtcgagagggaaacagcccagaccaccagttaaggccccaaaatgataatgaagtggtaaaggaggtgaaaatgcaaatacaaccaggaggttggcttagaagcagccatcctttaaagagtgcgtaatagctcactg

SEQ ID NO: 16 - DNA, 573 bp, Prototheca wickerhamii
tgttgaagaatgagccgtcgacttaaaataaatggcaggctaagagaattaataactcgaaacctaagcgaaagcaagtcttaatagggcgctaatttaacaaaacattaaataaaatctaaagtcatttattttagacccgaacctgagtgatctaaccatggtcaggatgaaacttgggtgacaccaagtggaagtccgaaccgaccgatgttgaaaaatcggcggatgaactgtggttagtggtgaaataccagtcgaactcagagctagctggttctccccgaaatgcgttgaggcgcagcaatatatctcgtctatctaggggtaaagcactgtttcggtgcgggctatgaaaatggtaccaaatcgtggcaaactctgaatactagaaatgacgatatattagtgagactatgggggataagctccatagtcgagagggaaacagcccagaccaccagttaaggccccaaaatgataatgaagtggtaaaggaggtgaaaatgcaaatacaaccaggaggttggcttagaagcagccatcctttaaagagtgcgtaatagctcactg

SEQ ID NO: 17 - DNA, 541 bp, Prototheca moriformis
tgttgaagaatgagccggcgagttaaaaagagtggcgtggttaaagaaaattctctggaaccatagcgaaagcaagtttaacaagcttaagtcactttttttagacccgaaaccgagtgatctacccatgatcagggtgaagtgttggtaaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttcttttgtgggctccgaaagttgtacctcaaagtggcaaactctgaatactctatttagatatctactagtgagaccttgggggataagctccttggtcgaaagggaaacagcccagatcaccagttaaggccccaaaatgaaaatgatagtgactaaggatgtgagtatgtcaaaacctccagcaggttagcttagaagcagcaatcctttcaagagtgcgtaatagctcactg

SEQ ID NO: 18 - DNA, 541 bp, Prototheca zopfii
tgttgaagaatgagccggcgagttaaaaagagtggcatggttaaagaaaattctctggagccatagcgaaagcaagtttaacaagcttaagtcactttttttagacccgaaaccgagtgatctacccatgatcagggtgaagtgttggtaaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttctttcgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggatgtgagtatgtcaaaacctccagcaggttagcttagaagcagcaatcctttcaagagtgcgtaatagctcactg

SEQ ID NO: 19 - DNA, 565 bp, Prototheca moriformis
tgttgaagaatgagccggcgacttagaaaaggtggcatggttaaggaaatattccgaagccgtagcaaaagcgagtctgaatagggcgataaaatatattaatatttagaatctagtcattttttctagacccgaacccgggtgatctaaccatgaccaggatgaagcttgggtgataccaagtgaaggtccgaaccgaccgatgttgaaaaatcggcggatgagttgtggttagcggtgaaataccagtcgaacccggagctagctggttctccccgaaatgcgttgaggcgcagcagtacatctagtctatctaggggtaaagcactgtttcggtgcgggctgtgagaacggtaccaaatcgtggcaaactctgaatactagaaatgacgatgtagtagtgagactgtgggggataagctccattgtcaagagggaaacagcccagaccaccagctaaggccccaaaatggtaatgtagtgacaaaggaggtgaaaatgcaaatacaaccaggaggttggcttagaagcagccatcctttaaagagtgcgtaatagctcactg

SEQ ID NO: 20 - protein, 550 aa, Chicorium intybus
MSNSSNASESLFPATSEQPYRTAFHFQPPQNWMNDPNGPMCYNGVYHLFYQYNPFGPLWNLRMYWAHSVSHDLINWIHLDLAFAPTEPFDINGCLSGSATVLPGNKPIMLYTGIDTENRQVQNLAVPKDLSDPYLREWVKHTGNPIISLPEEIQPDDFRDPTTTWLEEDGTWRLLVGSQKDKTGIAFLYHSGDFVNWTKSDSPLHKVSGTGMWECVDFFPVWVDSTNGVDTSIINPSNRVKHVLKLGIQDHGKDCYLIGKYSADKENYVPEDELTLSTLRLDYGMYYASKSFFDPVKNRRIMTAWVNESDSEADVIARGWSGVQSFPRSLWLDKNQKQLLQWPIEEIEMLHQNEVSFHNKKLDGGSSLEVLGITASQADVKISFKLANLEEAEELDPSWVDPQLICSENDASKKGKFGPFGLLALASSDLREQTAIFFRVFRKNGRYVVLMCSDQSRSSMKNGIEKRTYGAFVDIDPQQDEISLRTLIDHSIVESFGGRGKTCITTRVYPTLAIGEQARLFAFNHGTESVEISELSAWSMKKAQMKVEEP

SEQ ID NO: 21 - protein, 581 aa, Schizosaccharomyces pombe
MFLKYILASGICLVSLLSSTNAAPRHLYVKRYPVIYNASNITEVSNSTTVPPPPFVNTTAPNGTCLGNYNEYLPSGYYNATDRPKIHFTPSSGFMNDPNGLVYTGGVYHMFFQYSPKTLTAGEVHWGHTVSKDLIHWENYPIAIYPDEHENGVLSLPFSGSAVVDVHNSSGLFSNDTIPEERIVLIYTDHWTGVAERQAIAYTTDGGYTFKKYSGNPVLDINSLQFRDPKVIWDFDANRWVMIVAMSQNYGIAFYSSYDLIHWTELSVFSTSGYLGLQYECPGMARVPVEGTDEYKWVLFISINPGAPLGGSVVQYFVGDWNGTNFVPDDGQTRFVDLGKDFYASALYHSSSANADVIGVGWASNWQYTNQAPTQVFRSAMTVARKFTLRDVPQNPMTNLTSLIQTPLNVSLLRDETLFTAPVINSSSSLSGSPITLPSNTAFEFNVTLSINYTEGCTTGYCLGRIIIDSDDPYRLQSISVDVDFAASTLVINRAKAQMGWFNSLFTPSFANDIYIYGNVTLYGIVDNGLLELYVNNGEKTYTNDFFFLQGATPGQISFAAFQGVSFNNVTVTPLKTIWNC

SEQ ID NO: 22 - protein, 550 aa, Pichia anomala
MIQLSPLLLLPLFSVFNSIADASTEYLRPQIHLTPDQGWMNDPNGMFYDRKDKLWHVYFQHNPDKKSIWATPVTWGHSTSKDLLTWDYHGNALEPENDDEGIFSGSVVVDRNNTSGFFNDSTDPEQRIVAIYTNNAQLQTQEIAYSLDKGYSFIKYDQNPVINVNSSQQRDPKVLWHDESNQWIMVVAKTQEFKVQIYGSPDLKKWDLKSNFTSNGYLGFQYECPGLFKLPIENPLNDTVTSKWVLLLAINPGSPLGGSINEYFIGDFDGTTFHPDDGATRFMDIGKDFYAFQSFDNTEPEDGALGLAWASNWQYANTVPTENWRSSMSLVRNYTLKYVDVNPENYGLTLIQKPVYDTKETRLNETLKTLETINEYEVNDLKLDKSSFVATDFNTERNATGVFEFDLKFTQTDLKMGYSNMTTQFGLYIHSQTVKGSQETLQLVFDTLSTTWYIDRTTQHSFQRNSPVFTERISTYVEKIDTTDQGNVYTLYGVVDRNILELYFNDGSIAMTNTFFFREGKIPTSFEVVCDSEKSFITIDELSVRELARK

SEQ ID NO: 23 - protein, 533 aa, Debaryomyces occidentalis
MVQVLSVLVIPLLTLFFGYVASSSIDLSVDTSEYNRPLIHFTPEKGWMNDPNGLFYDKTAKLWHLYFQYNPNATAWGQPLYWGHATSNDLVHWDEHEIAIGPEHDNEGIFSGSIVVDHNNTSGFFNSSIDPNQRIVAIYTNNIPDLQTQDIAFSLDGGYTFTKYENNPVIDVSSNQFRDPKVFWHERFKSMDHGCSEIARVKIQIFGSANLKNWVLNSNFSSGYYGNQYGMSRLIEVPIENSDKSKWVMFLAINPGSPLGGSINQYFVGDFDGFQFVPDDSQTRFVDIGKDFYAFQTFSEVEHGVLGLAWASNWQYADQVPTNPWRSSTSLARNYTLRYVIQMLKLTANIDKSVLPDSINVVDKLKKKNVKLTNKKPIKTNFKGSTGLFDFNITFKVLNLNVSPGKTHFDILINSQELNSSVDSIKIGFDSSQSLFYIDRHIPNVEFPRKQFFTDKLAAYLEPLDYDQDLRVFSLYGIVDKNIIELYFNDGTVAMTNTFFMGEGKYPHDIQIVTDTEEPLFELESVIIRELNK

SEQ ID NO: 24 - protein, 654 aa, Oryza sativa
MATSRLTPAYDLKNAAAAVYTPLPEQPHSAEVEIRDRKPFKIISAIILSSLLLLALILVAVNYQAPPSHSSGDNSQPAAVMPPSRGVSQGVSEKAFRGASGAGNGVSFAWSNLMLSWQRTSYHFQPVKNWMNDPNGPLYYKGWYHLFYQYNPDSAVWGNITWGHAVSTDLINWLHLPFAMVPDQWYDVNGVWTGSATILPDGRIVMLYTGDTDDYVQDQNLAFPANLSDPLLVDWVKYPNNPVIYPPPGIGVKDFRDPTTAGTAGMQNGQRLVTIGSKVGKTGISLVYETTNFTTFKLLYGVLHAVPGTGMWECVDLYPVSTTGENGLDTSVNGLGVKHVLKTSLDDDKHDYYALGTYDPVKNKWTPDNPDLDVGIGLRLDYGKYYAARTFYDQNKQRRILWGWIGETDLEAVDLMKGWASLQAIPRTIVFDKKTGTNVLQRPEEEVESWSSGDPITQRRIFEPGSVVPIHVSGATQLDITASFEVDETLLETTSESHDAGYDCSNSGGAGTRGSLGPFGLLVVADEKLSELTPVYLYVAKGGDGKAKAHLCAYQTRSSMASGVEKEVYGSAVPVLDGENYSARILIDHSIVESFAQAGRTCVRSRDYPTKDIYGAARCFFFNNATEASVRASLKAWQMKSFIRPYPFIPDQKS

SEQ ID NO: 25 - protein, 690 aa, Allium cepa
MSSDDLESPPSSYLPIPPSDEFHDQPPPLRSWLRLLSIPLALMFLLFLATFLSNLESPPSDSGLVSDPVTFDVNPAVVRRGKDAGVSDKTSGVDSGFVLDPVAVDANSVVVHRGKDAGVSDKTSGVDSGLLKDSPLGPYPWTNQMLSWQRTGFHFQPVKNWMNDPNGPLYYKGWYHFFYQYNPEGAVWGNIAWGHAVSRDLVHWTHLPLAMVPDQWYDINGVWTGSATILPDGQIVMLYTGATNESVQVQNLAVPADQSDTLLLRWKKSEANPILVPPPGIGDKDFRDPTTAWYEPSDDTWRIVIGSKDSSHSGIAIVYSTKDFINYKLIPGILHAVERVGMWECVDFYPVATADSSHANHGLDPSARPSPAVKHVLKASMDDDRHDYYAIGTYDPAQNTWVPDDASVDVGIGLRYDWGKFYASKTFYDHAKKRRILWSWIGETDSETADIAKGWASLQGVPRTVLLDVKTGSNLITWPVVEIESLRTRPRDFSGITVDAGSTFKLDVGGAAQLDIEAEFKISSEELEAVKEADVSYNCSSSGGAAERGVLGPFGLLVLANQDLTEQTATYFYVSRGMDGGLNTHFCQDEKRSSKASDIVKRIVGHSVPVLDGESFALRILVDHSIVESFAQGGRASATSRVYPTEAIYNNARVFVFNNATGAKVTAQSLKVWHMSTAINEIYDPATSVM

SEQ ID NO: 26 - protein, 501 aa, Beta vulgaris
  misc_feature (382)..(382): Xaa can be any naturally occurring amino acid
LFYQYNPNGVIWGPPVWGHSTSKDLVNWVPQPLTMEPEMAANINGSWSGSATILPGNKPAILFTGLDPKYEQVQVLAYPKDTSDPNLKEWFLAPQNPVMFPTPQNQINATSFRDPTTAWRLPDGVWRLLIGSKRGQRGLSLLFRSRDFVHWVQAKHPLYSDKLSGMWECPDFFPVYANGDQMGVDTSIIGSHVKHVLKNSLDITKHDIYTIGDYNIKKDAYTPDIGYMNDSSLRYDYGKYYASKTFFDDAKKERILLGWANESSSVEDDIKKGWSGIHTIPRKIWLDKLGKQLIQWPIANIEKLRQKPVNIYRKVLKGGSQIEVSGITAAQADVEISFKIKDLKNVEKFDASWTSPQLLCSKKGASVKGGLGPFGLLTLASXGLEEYTAVFFRIFKAYDNKFVVLMCSDQSRSSLNPTNDKTTYGTFVDVNPIREGLSLRVLIDHSVVESFGAKGKNVITARVYPTLAINEKAHLYVFNRGTSNVEITGLTAWSMKKANIA

SEQ ID NO: 27 - protein, 518 aa, Bifidobacterium breve
MTDFTPETPVLTPIRDHAAELAKAEAGVAEMAAKRNNRWYPKYHIASNGGWINDPNGLCFYKGRWHVFYQLHPYGTQWGPMHWGHVSSTDMLNWKREPIMFAPSLEQEKDGVFSGSAVIDDNGDLRFYYTGHRWANGHDNTGGDWQVQMTALPDNDELTSATKQGMIIDCPTDKVDHHYRDPKVWKTGDTWYMTFGVSSEDKRGQMWLFSSKDMVRWEYERVLFQHPDPDVFMLECPDFFPIKDKDGNEKWVIGFSAMGSKPSGFMNRNVNNAGYMIGTWEPGGEFKPETEFRLWDCGHNYYAPQSFNVDGRQIVYGWMSPFVQPIPMEDDGWCGQLTLPREITLDDDGDVVTAPVAEMEGLREDTLDHGSITLDMDGEQVIADDAEAVEIEMTIDLAASTADRAGLKIHATEDGAYTYVAYDDQIGRVVVDRQAMANGDHGYRAAPLTDAELASGKLDLRVFVDRGSVEVYVNGGHQVLSSYSYASEGPRAIKLVAEFGNLKVESLKLHHMKSIGLE

SEQ ID NO: 28 - protein, 532 aa, Saccharomyces cerevisae
MLLQAFLFLLAGFAAKISASMTNETSDRPLVHFTPNKGWMNDPNGLWYDEKDAKWHLYFQYNPNDTVWGTPLFWGHATSDDLTNWEDQPIAIAPKRNDSGAFSGSMVVDYNNTSGFFNDTIDPRQRCVAIWTYNTPESEEQYISYSLDGGYTFTEYQKNPVLAANSTQFRDPKVFWYEPSQKWIMTAAKSQDYKIEIYSSDDLKSWKLESAFANEGFLGYQYECPGLIEVPTEQDPSKSYWVMFISINPGAPAGGSFNQYFVGSFNGTHFEAFDNQSRVVDFGKDYYALQTFFNTDPTYGSALGIAWASNWEYSAFVPTNPWRSSMSLVRKFSLNTEYQANPETELINLKAEPILNISNAGPWSRFATNTTLTKANSYNVDLSNSTGTLEFELVYAVNTTQTISKSVFADLSLWFKGLEDPEEYLRMGFEVSASSFFLDRGNSKVKFVKENPYFTNRMSVNNQPFKSENDLSYYKVYGLLDQNILELYFNDGDVVSTNTYFMTTGNALGSVNMTTGVDNLFYIDKFQVREVK

SEQ ID NO: 29 - protein, 512 aa, Zymomonas mobilis
MESPSYKNLIKAEDAQKKAGKRLLSSEWYPGFHVTPLTGWMNDPNGLIFFKGEYHLFYQYYPFAPVWGPMHWGHAKSRDLVHWETLPVALAPGDLFDRDGCFSGCAVDNNGVLTLIYTGHIVLSNDSPDAIREVQCMATSIDGIHFQKEGIVLEKAPMPQVAHFRDPRVWKENDHWFMVVGYRTDDEKHQGIGHVALYRSENLKDWIFVKTLLGDNSQLPLGKRAFMWECPDFFSLGNRSVLMFSPQGLKASGYKNRNLFQNGYILGKWQAPQFTPETSFQELDYGHDFYAAQRFEAKDGRQILIAWFDMWENQKPSQRDGWAGCMTLPRKLDLIDNKIVMTPVREMEILRQSEKIESVVTLSDAEHPFTMDSPLQEIELIFDLEKSSAYQAGLALRCNGKGQETLLYIDRSQNRIILDRNRSGQNVKGIRSCPLPNTSKVRLHIFLDRSSIEIFVGDDQTQGLYSISSRIFPDKDSLKGRLFAIEGYAVFDSFKRWTLQDANLAAFSSDAC

SEQ ID NO: 30 - protein, 360 aa, Artificial Sequence
  synthetic construct
MAIKTNRQPVEKPPFTIGTLRKAIPAHCFERSALRGRAPDWSMLFAVITTIFSAAEKQWTNLEWKPKPNPPQLLDDHFGPHGLVFRRTFAIRSYEVGPDRSTSIVAVMNHLQEAALNHAKSVGILGDGFGTTLEMSKRDLIWVVKRTHVAVERYPAWGDTVEVECWVGASGNNGRRHDFLVRDCKTGEILTRCTSLSVMMNTRTRRLSKIPEEVRGEIGPAFIDNVAVKDEEIKKPQKLNDSTADYIQGGLTPRWNDLDINQHVNNIKYVDWILETVPDSIFESHHISSFTIEYRRECTMDSVLQSLTTVSGGSSEAGLVCEHLLQLEGGSEVLRAKTEWRPKLTDSFRGISVIPAESSV

SEQ ID NO: 31 - DNA, 4653 bp, Artificial Sequence
  synthetic polynucelotide
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggctatcaagacgaacaggcagcctgtggagaagcctccgttcacgatcgggacgctgcgcaaggccatccccgcgcactgtttcgagcgctcggcgcttcgtgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgatgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctt

SEQ ID NO: 32 - protein, 366 aa, Artificial Sequence
  synthetic construct
MAIKTNRQPVEKPPFTIGTLRKAIPAHCFERSALRGRAQLPDWSRLLTAITTVFVKSKRPDMHDRKSKRPDMLVDSFGLESTVQDGLVFRQSFSIRSYEIGTDRTASIETLMNHLQETSLNHCKSTGILLDGFGRTLEMCKRDLIWVVIKMQIKVNRYPAWGDTVEINTRFSRLGKIGMGRDWLISDCNTGEILVRATSAYAMMNQKTRRLSKLPYEVHQEIVPLFVDSPVIEDSDLKVHKFKVKTGDSIQKGLTPGWNDLDVNQHVSNVKYIGWILESMPTEVLETQELCSLALEYRRECGRDSVLESVTAMDPSKVGVRSQYQHLLRLEDGTAIVNGATEWRPKNAGANGAISTGKTSNGNSVS

SEQ ID NO: 33 - DNA, 4668 bp, Artificial Sequence
  synthetic polynucleotide
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggctatcaagacgaacaggcagcctgtggagaagcctccgttcacgatcgggacgctgcgcaaggccatccccgcgcactgtttcgagcgctcggcgcttcgtgggcgcgcccagctgcccgactggagccgcctgctgaccgccatcaccaccgtgttcgtgaagtccaagcgccccgacatgcacgaccgcaagtccaagcgccccgacatgctggtggacagcttcggcctggagtccaccgtgcaggacggcctggtgttccgccagtccttctccatccgctcctacgagatcggcaccgaccgcaccgccagcatcgagaccctgatgaaccacctgcaggagacctccctgaaccactgcaagagcaccggcatcctgctggacggcttcggccgcaccctggagatgtgcaagcgcgacctgatctgggtggtgatcaagatgcagatcaaggtgaaccgctaccccgcctggggcgacaccgtggagatcaacacccgcttcagccgcctgggcaagatcggcatgggccgcgactggctgatctccgactgcaacaccggcgagatcctggtgcgcgccaccagcgcctacgccatgatgaaccagaagacccgccgcctgtccaagctgccctacgaggtgcaccaggagatcgtgcccctgttcgtggacagccccgtgatcgaggactccgacctgaaggtgcacaagttcaaggtgaagaccggcgacagcatccagaagggcctgacccccggctggaacgacctggacgtgaaccagcacgtgtccaacgtgaagtacatcggctggatcctggagagcatgcccaccgaggtgctggagacccaggagctgtgctccctggccctggagtaccgccgcgagtgcggccgcgactccgtgctggagagcgtgaccgccatggaccccagcaaggtgggcgtgcgctcccagtaccagcacctgctgcgcctggaggacggcaccgccatcgtgaacggcgccaccgagtggcgccccaagaacgccggcgccaacggcgccatctccaccggcaagaccagcaacggcaactccgtgtccatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctt

SEQ ID NO: 34 - protein, 360 aa, Artificial Sequence
  synthetic construct
MAIKTNRQPVEKPPFTIGTLRKAIPAHCFERSALRGRAPDWSMLFAVITTIFSAAEKQWTNLEWKPKPKLPQLLDDHFGLHGLVFRRTFAIRSYEVGPDRSTSILAVMNHMQEATLNHAKSVGILGDGFGTTLEMSKRDLMWVVRRTHVAVERYPTWGDTVEVECWIGASGNNGMRRDFLVRDCKTGEILTRCTSLSVLMNTRTRRLSTIPDEVRGEIGPAFIDNVAVKDDEIKKLQKLNDSTADYIQGGLTPRWNDLDVNQHVNNLKYVAWVFETVPDSIFESHHISSFTLEYRRECTRDSVLRSLTTVSGGSSEAGLVCDHLLQLEGGSEVLRARTEWRPKLTDSFRGISVIPAEPRV

SEQ ID NO: 35 - DNA, 4653 bp, Artificial Sequence
  synthetic polynucleotide
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggctatcaagacgaacaggcagcctgtggagaagcctccgttcacgatcgggacgctgcgcaaggccatccccgcgcactgtttcgagcgctcggcgcttcgtgggcgcgcccccgactggtccatgctgttcgccgtgatcaccaccatcttcagcgccgccgagaagcagtggaccaacctggagtggaagcccaagcccaagctgccccagctgctggacgaccacttcggcctgcacggcctggtgttccgccgcaccttcgccatccgctcctacgaggtgggccccgaccgcagcacctccatcctggccgtgatgaaccacatgcaggaggccaccctgaaccacgccaagagcgtgggcatcctgggcgacggcttcggcaccaccctggagatgtccaagcgcgacctgatgtgggtggtgcgccgcacccacgtggccgtggagcgctaccccacctggggcgacaccgtggaggtggagtgctggatcggcgccagcggcaacaacggcatgcgccgcgacttcctggtgcgcgactgcaagaccggcgagatcctgacccgctgcacctccctgagcgtgctgatgaacacccgcacccgccgcctgagcaccatccccgacgaggtgcgcggcgagatcggccccgccttcatcgacaacgtggccgtgaaggacgacgagatcaagaagctgcagaagctgaacgactccaccgccgactacatccagggcggcctgaccccccgctggaacgacctggacgtgaaccagcacgtgaacaacctgaagtacgtggcctgggtgttcgagaccgtgcccgacagcatcttcgagtcccaccacatcagctccttcaccctggagtaccgccgcgagtgcacccgcgactccgtgctgcgcagcctgaccaccgtgagcggcggcagctccgaggccggcctggtgtgcgaccacctgctgcagctggagggcggcagcgaggtgctgcgcgcccgcaccgagtggcgccccaagctgaccgactccttccgcggcatcagcgtgatccccgccgagccccgcgtgatggactacaaggaccacgacggcgactacaaggaccacgacatcgactacaaggacgacgacgacaagtgatgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctt

SEQ ID NO: 36 - protein, 393 aa, Artificial Sequence
  synthetic construct
MAIKTNRQPVEKPPFTIGTLRKAIPAHCFERSALRGRAPANGSAVTLKSGSLNTQEDTLSSSPPPRAFFNQLPDWSMLLTAITTVFVAPEKRWTMFDRKSKRPNMLMDSFGLERVVQDGLVFRQSFSIRSYEICADRTASIETVMNHVQETSLNQCKSIGLLDDGFGRSPEMCKRDLIWVVTRMKIMVNRYPTWGDTIEVSTWLSQSGKIGMGRDWLISDCNTGEILVRATSVYAMMNQKTRRFSKLPHEVRQEFAPHFLDSPPAIEDNDGKLQKFDVKTGDSIRKGLTPGWYDLDVNQHVSNVKYIGWILESMPTEVLETQELCSLTLEYRRECGRDSVLESVTSMDPSKVGDRFQYRHLLRLEDGADIMKGRTEWRPKNAGTNGAISTGKT

SEQ ID NO: 37 - DNA, 4686 bp, Artificial Sequence
  synthetic construct
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggctatcaagacgaacaggcagcctgtggagaagcctccgttcacgatcgggacgctgcgcaaggccatccccgcgcactgtttcgagcgctcggcgcttcgtgggcgcgcccccgcgaacggcagcgcggtgaccctgaagtcgggctccctgaacacccaggaggacacgctgagctcgtccccccccccccgcgcgttcttcaaccagctgcccgactggagcatgctgctgaccgcgatcaccacggtcttcgtggcgcccgagaagcgctggaccatgttcgaccgcaagtcgaagcgccccaacatgctgatggactccttcggcctggagcgcgtggtccaggacggcctggtgttccgccagagcttctcgatccgctcctacgagatctgcgcggaccgcaccgcgagcatcgagacggtgatgaaccacgtccaggagacctcgctgaaccagtgcaagtccatcggcctgctggacgacggcttcggccgcagccccgagatgtgcaagcgcgacctgatctgggtggtcacccgcatgaagatcatggtgaaccgctaccccacgtggggcgacaccatcgaggtctcgacgtggctgtcccagagcggcaagatcggcatgggccgcgactggctgatctcggactgcaacaccggcgagatcctggtgcgcgcgacgtccgtctacgcgatgatgaaccagaagacccgccgcttcagcaagctgccccacgaggtgcgccaggagttcgcgccccacttcctggactcgccccccgcgatcgaggacaacgacggcaagctgcagaagttcgacgtcaagacgggcgactccatccgcaagggcctgacccccggctggtacgacctggacgtgaaccagcacgtgagcaacgtcaagtacatcggctggatcctggagtcgatgcccaccgaggtcctggagacgcaggagctgtgctccctgaccctggagtaccgccgcgagtgcggccgcgactcggtgctggagagcgtcaccagcatggacccctcgaaggtgggcgaccgcttccagtaccgccacctgctgcgcctggaggacggcgcggacatcatgaagggccgcaccgagtggcgccccaagaacgcgggcacgaacggcgcgatctccaccggcaagacgtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctc

SEQ ID NO: 38 - protein, 408 aa, Artificial Sequence
  synthetic construct
MAIKTNRQPVEKPPFTIGTLRKAIPAHCFERSALRGRAPANGSAVNLKSGSLNTQEDTSSSPPPRAFLNQLPDWSMLLTAITTVFVAAEKQWTMLDRKSKRPDMLVDSVGLKSIVRDGLVSRQSFLIRSYEIGADRTASIETLMNHLQETSINHCKSLGLLNDGFGRTPGMCKNDLIWVLTKMQIMVNRYPTWGDTVEINTWFSQSGKIGMASDWLISDCNTGEILIRATSVWAMMNQKTRRFSRLPYEVRQELTPHFVDSPHVIEDNDQKLHKFDVKTGDSIRKGLTPRWNDLDVNQHVSNVKYIGWILESMPIEVLETQELCSLTVEYRRECGMDSVLESVTAVDPSENGGRSQYKHLLRLEDGTDIVKSRTEWRPKNAGTNGAISTSTAKTSNGNSASDDDDKLG

SEQ ID NO: 39 - DNA, 1239 bp, Artificial Sequence
  synthetic construct
actagtatggctatcaagacgaacaggcagcctgtggagaagcctccgttcacgatcgggacgctgcgcaaggccatccccgcgcactgtttcgagcgctcggcgcttcgtgggcgcgcccccgcgaacggcagcgcggtgaacctgaagtcgggctccctgaacacccaggaggacacgagctcgtccccccccccccgcgcgttcctgaaccagctgcccgactggagcatgctgctgaccgcgatcaccaccgtcttcgtggcggcggagaagcagtggacgatgctggaccgcaagtcgaagcgccccgacatgctggtggactccgtcggcctgaagagcatcgtgcgcgacggcctggtctcgcgccagtccttcctgatccgcagctacgagatcggcgcggaccgcaccgcgtcgatcgagaccctgatgaaccacctgcaggagacgtccatcaaccactgcaagagcctgggcctgctgaacgacggcttcggccgcacccccggcatgtgcaagaacgacctgatctgggtgctgaccaagatgcagatcatggtcaaccgctaccccacgtggggcgacaccgtcgagatcaacacgtggttctcgcagtccggcaagatcggcatggcgagcgactggctgatctcggactgcaacaccggcgagatcctgatccgcgcgacctccgtgtgggcgatgatgaaccagaagacgcgccgcttcagccgcctgccctacgaggtccgccaggagctgaccccccacttcgtggactcgccccacgtcatcgaggacaacgaccagaagctgcacaagttcgacgtgaagaccggcgactccatccgcaagggcctgacgccccgctggaacgacctggacgtcaaccagcacgtgtcgaacgtgaagtacatcggctggatcctggagtccatgcccatcgaggtcctggagacccaggagctgtgctcgctgaccgtggagtaccgccgcgagtgcggcatggactccgtgctggagtcggtcacggcggtggaccccagcgagaacggcggccgcagccagtacaagcacctgctgcgcctggaggacggcaccgacatcgtcaagtcgcgcaccgagtggcgccccaagaacgcgggcacgaacggcgcgatctccaccagcaccgcgaagacgtcgaacggcaactccgcgagcgatgacgatgacaagctgggatgactcgag

SEQ ID NO: 40 - protein, 399 aa, Artificial Sequence
  synthetic construct
MATASTFSAFNARCGDLRRSAGSGPRRPARPLPVRGRAAQAATRVNGSKVGLKTDTNKLEDAPFIPSSAPRTFYNQLPDWSVLLAAITTIFLAAEKQWTLIDWKRGGPDMLSDAFGLPKIIENGLLYRQKFSIRSYEIGADQTASIETLMNHLQETALNHVKCAGLLGNGFGSTPEMSKMNLIWVVTKMQVLVEHYPSWGDVIEVDTWAAASGKNGMRRDWHVRDWQTGQTIMRASSNWVMMNQNTRRLSKFPEEVRAEIEPYFMERAPVIDDDNRKLPKLDDDTADHVRNGLTPRWSDLDVNQHVKNVKYIGWILESAPISILESHELASMTLEYRRECGRDSVLQSLTSVSNNCTDGSEELPIECQHLLRNEGGSEIVKGRTEWRPKKCGPFGAGRP

SEQ ID NO: 41 - DNA, 1212 bp, Artificial Sequence
  synthetic construct
actagtatggccaccgcatccactttctcggcgttcaatgcccgctgcggcgacctgcgtcgctcggcgggctccgggccccggcgcccagcgaggcccctccccgtgcgcgggcgcgccgcccaggcggccacccgcgtgaacggcagcaaggtgggcctgaagaccgacaccaacaagctggaggacgcgcccttcatcccctcgtccgccccccgcaccttctacaaccagctgcccgactggagcgtcctgctggcggccatcaccaccatcttcctggcggccgagaagcagtggaccctgatcgactggaagcgcggcggccccgacatgctgtcggacgcgttcggcctgcccaagatcatcgagaacggcctgctgtaccgccagaagttctccatccgcagctacgagatcggcgccgaccagaccgcctcgatcgagaccctgatgaaccacctgcaggagaccgcgctgaaccacgtcaagtgcgccggcctgctgggcaacggcttcggctccacccccgagatgagcaagatgaacctgatctgggtggtcaccaagatgcaggtgctggtcgagcactacccctcgtggggcgacgtgatcgaggtggacacctgggcggccgcgtccggcaagaacggcatgcgccgcgactggcacgtccgcgactggcagaccggccagaccatcatgcgcgccagctcgaactgggtgatgatgaaccagaacacccgccgcctgtccaagttccccgaggaggtccgcgccgagatcgagccctacttcatggagcgcgcccccgtgatcgacgacgacaaccgcaagctgcccaagctggacgacgacaccgcggaccacgtgcgcaacggcctgaccccccgctggagcgacctggacgtgaaccagcacgtcaagaacgtgaagtacatcggctggatcctggagtcggcccccatctccatcctggagagccacgagctggcctcgatgaccctggagtaccgccgcgagtgcggccgcgactccgtcctgcagagcctgacctcggtgtccaacaactgcaccgacggcagcgaggagctgcccatcgagtgccagcacctgctgcgcaacgagggcggctcggagatcgtcaagggccgcaccgagtggcgccccaagaagtgcggccccttcggcgccggccgcccctgactcgag

SEQ ID NO: 42 - protein, 415 aa, Artificial Sequence
  synthetic construct
MAIKTNRQPVEKPPFTIGTLRKAIPAHCFERSALRGRAANAHTVPKINGNKAGLLTPMESTKDEDIVAAPTVAPKRTFINQLPDWSMLLAAITTIFLAAEKQWTNLDWKPRRPDMLVDFDPFSLGRFVQDGLIFRQNFSIRSYEIGADRTASIETLMNHLQETALNHVRCIGLLDDGFGSTPEMTRRDLIWVVTRMQVLVDRYPSWGDVIEVDSWVTPSGKNGMKREWFLRDCKTGEILTRATSVWVMMNKRTRRLSKIPEEVRVEIEPYFVEHGVLDEDSRKLPKLNDNTANYIRRGLAPRWSDLDVNQHVNNVKYIGWILESVPSSLLESHELYGMTLEYRKECGKDGLLQSLTAVASDYGGGSLEAGVECDHLLRLEDGSEIMRGKTEWRPKRAANTTYFGSVDDIPPANNA

SEQ ID NO: 43 - DNA, 1260 bp, Artificial Sequence
  synthetic construct
actagtatggctatcaagacgaacaggcagcctgtggagaagcctccgttcacgatcgggacgctgcgcaaggccatccccgcgcactgtttcgagcgctcggcgcttcgtgggcgcgccgccaacgcccacaccgtgcccaagatcaacggcaacaaggccggcctgctgacccccatggagagcaccaaggacgaggacatcgtcgcggcccccaccgtggcgcccaagcgcaccttcatcaaccagctgcccgactggtcgatgctgctggccgcgatcaccaccatcttcctggcggccgagaagcagtggaccaacctggactggaagccccgccgccccgacatgctggtcgacttcgaccccttctccctgggccgcttcgtgcaggacggcctgatcttccgccagaacttcagcatccgctcgtacgagatcggcgcggaccgcaccgcctccatcgagaccctgatgaaccacctgcaggagaccgcgctgaaccacgtccgctgcatcggcctgctggacgacggcttcggcagcacccccgagatgacccgccgcgacctgatctgggtggtcacccgcatgcaggtcctggtggaccgctacccctcgtggggcgacgtgatcgaggtcgactcctgggtgacccccagcggcaagaacggcatgaagcgcgagtggttcctgcgcgactgcaagaccggcgagatcctgacccgcgccacctcggtctgggtgatgatgaacaagcgcacccgccgcctgtccaagatccccgaggaggtccgcgtggagatcgagccctacttcgtcgagcacggcgtgctggacgaggactcgcgcaagctgcccaagctgaacgacaacaccgccaactacatccgccgcggcctggcgccccgctggtccgacctggacgtcaaccagcacgtgaacaacgtcaagtacatcggctggatcctggagagcgtgcccagcagcctgctggagtcgcacgagctgtacggcatgaccctggagtaccgcaaggagtgcggcaaggacggcctgctgcagtccctgaccgccgtcgccagcgactacggcggcggctcgctggaggccggcgtggagtgcgaccacctgctgcgcctggaggacggctccgagatcatgcgcggcaagaccgagtggcgccccaagcgcgccgcgaacaccacctacttcggcagcgtcgacgacatcccccccgccaacaacgcgtgactcgag

SEQ ID NO: 44 - protein, 362 aa, Artificial Sequence
  synthetic construct
MATASTFSAFNARCGDLRRSAGSGPRRPARPLPVRGRASMLLSAVTTVFGVAEKQWPMLDRKSKRPDMLVEPLGVDRIVYDGVSFRQSFSIRSYEIGADRTASIETLMNMFQETSLNHCKIIGLLNDGFGRTPEMCKRDLIWVVTKMQIEVNRYPTWGDTIEVNTWVSASGKHGMGRDWLISDCHTGEILIRATSVWAMMNQKTRRLSKIPYEVRQEIEPQFVDSAPVIVDDRKFHKLDLKTGDSICNGLTPRWTDLDVNQHVNNVKYIGWILQSVPTEVFETQELCGLTLEYRRECGRDSVLESVTAMDPSKEGDRSLYQHLLRLEDGADIVKGRTEWRPKNAGAKGAILTGKTSNGNSIS

SEQ ID NO: 45 - DNA, 1101 bp, Artificial Sequence
  synthetic construct
actagtatggccaccgcatccactttctcggcgttcaatgcccgctgcggcgacctgcgtcgctcggcgggctccgggccccggcgcccagcgaggcccctccccgtgcgcgggcgcgccagcatgctgctgtcggcggtgaccacggtcttcggcgtggccgagaagcagtggcccatgctggaccgcaagtccaagcgccccgacatgctggtcgagcccctgggcgtggaccgcatcgtctacgacggcgtgagcttccgccagtcgttctccatccgcagctacgagatcggcgccgaccgcaccgcctcgatcgagacgctgatgaacatgttccaggagacctccctgaaccactgcaagatcatcggcctgctgaacgacggcttcggccgcacgcccgagatgtgcaagcgcgacctgatctgggtcgtgaccaagatgcagatcgaggtgaaccgctaccccacgtggggcgacaccatcgaggtcaacacgtgggtgagcgcctcgggcaagcacggcatgggccgcgactggctgatctccgactgccacaccggcgagatcctgatccgcgcgacgagcgtctgggcgatgatgaaccagaagacccgccgcctgtcgaagatcccctacgaggtgcgccaggagatcgagccccagttcgtcgactccgcccccgtgatcgtggacgaccgcaagttccacaagctggacctgaagacgggcgacagcatctgcaacggcctgaccccccgctggacggacctggacgtgaaccagcacgtcaacaacgtgaagtacatcggctggatcctgcagtcggtccccaccgaggtgttcgagacgcaggagctgtgcggcctgaccctggagtaccgccgcgagtgcggccgcgactccgtgctggagagcgtcacggccatggacccctcgaaggagggcgaccgctccctgtaccagcacctgctgcgcctggaggacggcgcggacatcgtgaagggccgcaccgagtggcgccccaagaacgccggcgccaagggcgccatcctgacgggcaagaccagcaacggcaactcgatctcctgactcgag

SEQ ID NO: 46 - protein, 369 aa, Artificial Sequence
  synthetic construct
MATASTFSAFNARCGDLRRSAGSGPRRPARPLPVRGRAQLPDWSMLLAAITTLFLAAEKQWMMLDWKPKRPDMLVDPFGLGRFVQDGLVFRNNFSIRSYEIGADRTASIETLMNHLQETALNHVKSVGLLEDGLGSTREMSLRNLIWVVTKMQVAVDRYPTWGDEVQVSSWATAIGKNGMRREWIVTDFRTGETLLRATSVWVMMNKLTRRISKIPEEVWHEIGPSFIDAPPLPTVEDDGRKLTRFDESSADFIRKGLTPRWSDLDINQHVNNVKYIGWLLESAPPEIHESHEIASLTLEYRRECGRDSVLNSATKVSDSSQLGKSAVECNHLVRLQNGGEIVKGRTVWRPKRPLYNDGAVVDVPAKTS

SEQ ID NO: 47 - DNA, 1122 bp, Artificial Sequence
  synthetic construct
actagtatggccaccgcatccactttctcggcgttcaatgcccgctgcggcgacctgcgtcgctcggcgggctccgggccccggcgcccagcgaggcccctccccgtgcgcgggcgcgcccagctgcccgactggagcatgctgctggccgcgatcaccaccctgttcctggcggccgagaagcagtggatgatgctggactggaagcccaagcgccccgacatgctggtggaccccttcggcctgggccgcttcgtgcaggacggcctggtgttccgcaacaacttcagcatccgcagctacgagatcggcgcggaccgcaccgccagcatcgagaccctgatgaaccacctgcaggagaccgccctgaaccacgtgaagagcgtgggcctgctggaggacggcctgggcagcacccgcgagatgagcctgcgcaacctgatctgggtggtgaccaagatgcaggtggcggtggaccgctaccccacctggggcgacgaggtgcaggtgagcagctgggcgaccgccatcggcaagaacggcatgcgccgcgagtggatcgtgaccgacttccgcaccggcgagaccctgctgcgcgccaccagcgtgtgggtgatgatgaacaagctgacccgccgcatcagcaagatccccgaggaggtgtggcacgagatcggccccagcttcatcgacgcgccccccctgcccaccgtggaggacgacggccgcaagctgacccgcttcgacgagagcagcgccgacttcatccgcaagggcctgaccccccgctggagcgacctggacatcaaccagcacgtgaacaacgtgaagtacatcggctggctgctggagagcgcgccccccgagatccacgagagccacgagatcgccagcctgaccctggagtaccgccgcgagtgcggccgcgacagcgtgctgaacagcgccaccaaggtgagcgacagcagccagctgggcaagagcgccgtggagtgcaaccacctggtgcgcctgcagaacggcggcgagatcgtgaagggccgcaccgtgtggcgccccaagcgccccctgtacaacgacggcgccgtggtggacgtgcccgccaagaccagctgactcgag

SEQ ID NO: 48 - DNA, 120 bp, Artificial Sequence
  synthetic construct
actagtatggctatcaagacgaacaggcagcctgtggagaagcctccgttcacgatcgggacgctgcgcaaggccatccccgcgcactgtttcgagcgctcggcgcttcgtgggcgcgcc

SEQ ID NO: 49 - DNA, 120 bp, Artificial Sequence
  synthetic construct
actagtatggccaccgcatccactttctcggcgttcaatgcccgctgcggcgacctgcgtcgctcggcgggctccgggccccggcgcccagcgaggcccctccccgtgcgcgggcgcgcc

SEQ ID NO: 50 - DNA, 6207 bp, Ulmus americana
gctcttcggccgccgccactcctgctcgagcgcgcccgactcgcgctccgcctgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgcccagctgcccgactggagcatgctgctggccgcgatcaccaccctgttcctggcggccgagaagcagtggatgatgctggactggaagcccaagcgccccgacatgctggtggaccccttcggcctgggccgcttcgtgcaggacggcctggtgttccgcaacaacttcagcatccgcagctacgagatcggcgcggaccgcaccgccagcatcgagaccctgatgaaccacctgcaggagaccgccctgaaccacgtgaagagcgtgggcctgctggaggacggcctgggcagcacccgcgagatgagcctgcgcaacctgatctgggtggtgaccaagatgcaggtggcggtggaccgctaccccacctggggcgacgaggtgcaggtgagcagctgggcgaccgccatcggcaagaacggcatgcgccgcgagtggatcgtgaccgacttccgcaccggcgagaccctgctgcgcgccaccagcgtgtgggtgatgatgaacaagctgacccgccgcatcagcaagatccccgaggaggtgtggcacgagatcggccccagcttcatcgacgcgccccccctgcccaccgtggaggacgacggccgcaagctgacccgcttcgacgagagcagcgccgacttcatccgcaagggcctgaccccccgctggagcgacctggacatcaaccagcacgtgaacaacgtgaagtacatcggctggctgctggagagcgcgccccccgagatccacgagagccacgagatcgccagcctgaccctggagtaccgccgcgagtgcggccgcgacagcgtgctgaacagcgccaccaaggtgagcgacagcagccagctgggcaagagcgccgtggagtgcaaccacctggtgcgcctgcagaacggcggcgagatcgtgaagggccgcaccgtgtggcgccccaagcgccccctgtacaacgacggcgccgtggtggacgtgcccgccaagaccagcgatgacgatgacaagctgggatgactcgagttaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctccttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 51 - DNA, 5576 bp, Cinnamomum camphora
gaattcgccctcccgtgatcacacaggtgccttgcgagcgtgatcacactattttgggggtcctacagtactgaaatggtgagaagtcgtactgaaatcaaggatgaacaatgaaaatggtgctgtggtggcttctcaaaggtcaagaatcagtcgctcgcgtcaggaaatcgcggcgtcaaccagcgtgggcgcggtcagtggccccgcactggtcaccatagcctctcctgccacagtagcgatcccctgggcgttcactctcagcagcggctgtactgcctcccagattttcttcttctggacctgcgggcgtgagaggatgagcagggtgggccaagggctcaatcctgaacggccctcattcggtttccaatcccacaacacatacccacagcaggtcagaccacgcattccaccatgcgcaccaataacgtgtccttacctgattgggtgtggcaggctccgtggacaggagtgcctcgtcccccgcccagacccgctcccccgtcacggcggcgtccgggacccgcagcggctccaccgcggtgtgatccgcgttggcggcgcagagcagcatcccagccgatttgaccccgcgcatgctccgaggcttgaggttggccagcaccaccacccgccggccgacaaggtcctccagggtcacgtgccggaccaggccactcacgatggtgcgagggcccccctcctcgccgaggtcgatctgctcgacgtacagactgcgacatgcgtggcgagtggtcatcagaaggaagcaggtgtgcagaaggggcacgtggttggtattgagagtagccaaagctttgtgccaatcagaaagtcaacgcagctgcctgcctggctcgcgtacaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagcatattcaaacacctagatcactaccacttctacacaggccactcgagcttgtgatcgcactccgctaagggggcgcctcttcccttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatcccctccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatgacgttcggggtcgccctcccggccatgggccgcggtgtctcccttccccggcccagggtcgcggtgcgcgcccagtcggcgagtcaggttttggagagcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctggtacccgtacccatcagcatccgggtgaatcttggcctccaagatatggccaatcctcacatccagcttggcaaaatcgactagactgtctgcaagtgggaatgtggagcacaaggttgcttgtagcgatcgacagactggtggggtacattgacaggtgggcagcgccgcatccatcgtgcctgacgcgagcgccgccggttgctcgcccgtgcctgccgtcaaagagcggcagagaaatcgggaaccgaaaacgtcacattgcctgatgttgttacatgctggactagactttcttggcgtgggtctgctcctcgccaggtgcgcgacgcctcggggctgggtgcgagggagccgtgcggccacgcatttgacaagacccaaagctcgcatctcagacggtcaaccgttcgtattatacattcaacatatggtacatacgcaaaaagcatgccaacgatgacataggcgaattc

SEQ ID NO: 52 - DNA, 4674 bp, Artificial Sequence
  synthetic construct
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgcccagctgcccgactggagccgcctgctgaccgccatcaccaccgtgttcgtgaagtccaagcgccccgacatgcacgaccgcaagtccaagcgccccgacatgctggtggacagcttcggcctggagtccaccgtgcaggacggcctggtgttccgccagtccttctccatccgctcctacgagatcggcaccgaccgcaccgccagcatcgagaccctgatgaaccacctgcaggagacctccctgaaccactgcaagagcaccggcatcctgctggacggcttcggccgcaccctggagatgtgcaagcgcgacctgatctgggtggtgatcaagatgcagatcaaggtgaaccgctaccccgcctggggcgacaccgtggagatcaacacccgcttcagccgcctgggcaagatcggcatgggccgcgactggctgatctccgactgcaacaccggcgagatcctggtgcgcgccaccagcgcctacgccatgatgaaccagaagacccgccgcctgtccaagctgccctacgaggtgcaccaggagatcgtgcccctgttcgtggacagccccgtgatcgaggactccgacctgaaggtgcacaagttcaaggtgaagaccggcgacagcatccagaagggcctgacccccggctggaacgacctggacgtgaaccagcacgtgtccaacgtgaagtacatcggctggatcctggagagcatgcccaccgaggtgctggagacccaggagctgtgctccctggccctggagtaccgccgcgagtgcggccgcgactccgtgctggagagcgtgaccgccatggaccccagcaaggtgggcgtgcgctcccagtaccagcacctgctgcgcctggaggacggcaccgccatcgtgaacggcgccaccgagtggcgccccaagaacgccggcgccaacggcgccatctccaccggcaagaccagcaacggcaactccgtgtccatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctc

SEQ ID NO: 53 - DNA, 4656 bp, Artificial Sequence
  synthetic construct
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttcagcgccgccgagaagcagtggaccaacctggagtggaagcccaagcccaagctgccccagctgctggacgaccacttcggcctgcacggcctggtgttccgccgcaccttcgccatccgctcctacgaggtgggccccgaccgcagcacctccatcctggccgtgatgaaccacatgcaggaggccaccctgaaccacgccaagagcgtgggcatcctgggcgacggcttcggcaccaccctggagatgtccaagcgcgacctgatgtgggtggtgcgccgcacccacgtggccgtggagcgctaccccacctggggcgacaccgtggaggtggagtgctggatcggcgccagcggcaacaacggcatgcgccgcgacttcctggtgcgcgactgcaagaccggcgagatcctgacccgctgcacctccctgagcgtgctgatgaacacccgcacccgccgcctgagcaccatccccgacgaggtgcgcggcgagatcggccccgccttcatcgacaacgtggccgtgaaggacgacgagatcaagaagctgcagaagctgaacgactccaccgccgactacatccagggcggcctgaccccccgctggaacgacctggacgtgaaccagcacgtgaacaacctgaagtacgtggcctgggtgttcgagaccgtgcccgacagcatcttcgagtcccaccacatcagctccttcaccctggagtaccgccgcgagtgcacccgcgactccgtgctgcgcagcctgaccaccgtgagcggcggcagctccgaggccggcctggtgtgcgaccacctgctgcagctggagggcggcagcgaggtgctgcgcgcccgcaccgagtggcgccccaagctgaccgactccttccgcggcatcagcgtgatccccgccgagccccgcgtgatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctc

SEQ ID NO: 54 - DNA, 4635 bp, Artificial Sequence
  synthetic construct
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgcccagctgcccgactggagcatgctgctggccgcgatcaccaccctgttcctggcggccgagaagcagtggatgatgctggactggaagcccaagcgccccgacatgctggtggaccccttcggcctgggccgcttcgtgcaggacggcctggtgttccgcaacaacttcagcatccgcagctacgagatcggcgcggaccgcaccgccagcatcgagaccctgatgaaccacctgcaggagaccgccctgaaccacgtgaagagcgtgggcctgctggaggacggcctgggcagcacccgcgagatgagcctgcgcaacctgatctgggtggtgaccaagatgcaggtggcggtggaccgctaccccacctggggcgacgaggtgcaggtgagcagctgggcgaccgccatcggcaagaacggcatgcgccgcgagtggatcgtgaccgacttccgcaccggcgagaccctgctgcgcgccaccagcgtgtgggtgatgatgaacaagctgacccgccgcatcagcaagatccccgaggaggtgtggcacgagatcggccccagcttcatcgacgcgccccccctgcccaccgtggaggacgacggccgcaagctgacccgcttcgacgagagcagcgccgacttcatccgcaagggcctgaccccccgctggagcgacctggacatcaaccagcacgtgaacaacgtgaagtacatcggctggctgctggagagcgcgccccccgagatccacgagagccacgagatcgccagcctgaccctggagtaccgccgcgagtgcggccgcgacagcgtgctgaacagcgccaccaaggtgagcgacagcagccagctgggcaagagcgccgtggagtgcaaccacctggtgcgcctgcagaacggcggcgagatcgtgaagggccgcaccgtgtggcgccccaagcgccccctgtacaacgacggcgccgtggtggacgtgcccgccaagaccagcgatgacgatgacaagctgggatgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctc

SEQ ID NO: 55 - DNA, 997 bp, Prototheca moriformis
cctgtcgatcgaagagaaggagacatgtgtacattattggtgtgagggcgctgaatcggccattttttaaaatgatcacgctcatgccaatagacgcggcacataacgacgttcaaacccccgccaaagccgcggacaaccccatccctccacaccccccacacaaagaacccgccaccgcttaccttgcccacgaggtaggcctttcgttgcgcaaaaccggcctcggtgatgaatgcatgcccgttcctgacgagcgctgcccgggccaacacgctcttttgctgcgtctcctcaggcttgggggcctccttgggcttgggtgccgccatgatctgcgcgcatcagagaaacgttgctggtaaaaaggagcgcccggctgcgcaatatatatataggcatgccaacacagcccaacctcactcgggagcccgtcccaccacccccaagtcgcgtgccttgacggcatactgctgcagaagcttcatgagaatgatgccgaacaagaggggcacgaggacccaatcccggacatccttgtcgataatgatctcgtgagtccccatcgtccgcccgacgctccggggagcccgccgatgctcaagacgagagggccctcgaccaggaggggctggcccgggcgggcactggcgtcgaaggtgcgcccgtcgttcgcctgcagtcctatgccacaaaacaagtcttctgacggggtgcgtttgctcccgtgcgggcaggcaacagaggtattcaccctggtcatggggagatcggcgatcgagctgggataagagatacttctggcaagcaatgacaacttgtcaggaccggaccgtgccatatatttctcacctagcgccgcaaaacctaacaatttgggagtcactgtgccactgagttcgactggtagctgaatggagtcgctgctccactaaacgaattgtcagcaccgccagccggccgaggacccgagtcatagcgagggtagtagcgcgcc

SEQ ID NO: 56 - DNA, 753 bp, Prototheca moriformis
actaattgcaatcgtgcagtaatcatcgatatggtcacaagtagatcccctactgacaccctctcgtacatgtaggcaatgtcatcggcgccgtcctgctgaccgatgccgacgtagcagagcagacccgggccgatctgggatacgagccggccctccacctgcgctcgaggtggaatcaagtaaataaccaatacacttttcgacaccacacagagttgcacggacggtggcgtacctctacgctcgcgctcttcacgcgctggacgaccgcacgcatgagcccgggtggcttggtctgggctgcaaaaatgcacaacaaacaagtatcagacgctcatggatgcacacgcgctcccaagcacgctcagactaaatattacagtagctcgtatctgataagatatcgagacataccgctcaactcacccgcaaactgcgccccgccaggtgatgcgcacagggccccaccatgcgatccatcgcatcgctcctcgagggcgctatcacgtggccggagagcgttcacagcgtacgccactgtatctgggcggtatgcggtccgtcaacatggagacagatacccgcaccaccaccttgcaagctcttccatattggaagtagaaaattgtaattgtatcatcgcacgaggggccaacttgccgtcggcgagctgggcgacgaacaccacctggacgttgtcgagactcgctcgtgccgtgcgccgggccgctgggtatccagaccgtcgcc

SEQ ID NO: 57 - DNA, 1122 bp, Prototheca moriformis
caacgacaaccagcaggcaactcggtcagcgacccaacacgcgagtcaaattgttgcgtgttcttgccttgtctatttactgtgatagcaagactgtcggtcagtcaataccgcggtgcgcacgtcggggtgccaagcctagcagagcacgggacggctggtgctgtgcgccagctcagctcgcttcgcgaccaattgtaggaccggcaaagtcaccaaaacatgccagcggtgcgattcaattggtcatgagctctacaaaattgttttgtgcgtcgcgcaggtatccaacggcgcggcagagaaagtttgacagctctcgatttcatctcggaaaaatggggagaatttatgacacacaagtgcgcaggcggcccaggcggccagcatattctggcgtgacctgggccgcccacaaaatgcttggatgcactctaaaataattatatttgccatgaacaagggaagagttaccgcacccagccctagacttgggcgcccgagcaaggttacgtcaagccaccttcgcccatcgcccaactccgtattccccgacagccgcacgtggccctcgccggaatgaaccctgaatcggcatcacgccacgcgttcgccaatcgttccgctctctggcttcatcggcctgcgccttcacgtcgtggtcacgacagtgcattcatacttccatttgcacctcggcacacacttttacgcatcgcctacccttgctgcggcagtctagggtcactttgcagccatgggacagtgctacaccaccgtcggtgcgcaaagctatttcaagtgaaccgtgggcggaaaaaaggaatgtacactgtctcaaccgactcctacaattgtttaccatgcagatcagagctcgacggccatcatcgagcaggtgtggggccttggtggcgcggcgcggggccccagggcgtcgcaggcattgatggcactctgagactttcgcacgcgcatgagggaccccatcaagagaagagtgtgtctttatgtccccattcatgatgatgtatcttgtgattgtcgcagtttggcaagtttaaccggatcgccgctccaggtgtggcgtggcggatttttctaggggtgcttgagcagtcg

SEQ ID NO: 58 - DNA, 574 bp, Prototheca moriformis
ggcccagggccctgcggatggcccacaccagatctagcctctcttatgccatgcccgcctcgctgcccgtcgtatccccccgccgatccgcgcgtaggggaccgcggcctgacccacgccacgaaagagctttgctcctcaatttctcgccaacagaaccgtatcaaacgctcaacgcctatcccgaacaatccgtattcacaccaaatcgagtataccggactggtttgcctagtcttgaaggaaatgatcccgtccatgctcggaagggggagcgggcggaggatcctactcatctctgaaatgggattggtccgaagatgggttgggcaagcacgtgccaaaccccagcgagttgctgacgagcaggctcatccaatcccccggcgaatcctccctcacgccccgcatgcatacaagtccctcccacacgccccctcccatccattttcgcctggtccgaacgcgagcggcgtcgaggcggaccacttgctccgcagcgccgtctgggtctccaccccacagcggctttgctgccagaggcaccccccttgccccacctcctcttgcagcc

SEQ ID NO: 59 - DNA, 1096 bp, Prototheca moriformis
ccaggcaggcggtagggttgccgattgcttgagcgaattggaagatataattttttgtggtgtccctggacgctgtttgtggcgctcctttttggagaagattgcgtgggggagctttccatgtaccacgcttccttctgaaaggattctggccgagtcctgatgagcccaaagaaaacacctgcctttcagtgctggcactctgaaaacgtcaacagatgattatacatgtcacaaaaggcagccgattaggaacgggagctctggccgttcgtttggctgcctgggctgattgaagtgatccaccctgttcgaatgaaggcggtcgagtcgaattatcgaccggagctgtcgggaaggcgtccggggcagagtgaggtgctgcggcctggttgtcgttcaaaaagaccccggtagcccaacaatcacgaacgaaaggaatataattgcttgcatactatacattcagtttctatgtggcgggtagacaagtctcatgggcttctaaaggctgtcccttgaaggctacttataaaaacttgctgcgccatggcacggatcgcgcttgcgcaggctgcaaccctgcgcgcaaggtcaaatacacagcaaaagatactaacagaatttctaaaaacatttaaatatttgtttcgaccagccaattgtggtcgtaggcacgcaaaagactttgttttgcgcccaccgagcatccacgctggcagtcaagccagtccgatgtgcattgcgtggcagcatcgaggagcatcaaaaacctcgtgcacgcttttctgtcaatcatcatcaaccactccaccatgtatacccgatgcatcgcggtgcgcagcgcgccacgcgtcccagacccgcccaaaaacccagcagcggcgaaagcaaatcttcacttgcccgaaaccccgagcagcggcattcacacgtgggcgaaaaccccacttgccctaacaggcgtatgtctgctgtcacgatgcctgacaacggtattatagatatacactgattaatgtttgagtgtgtgcgagtcgcgaatcaggaatgaattgctagtaggcactccgaccgggcgggggccgagggacca

SEQ ID NO: 60 - DNA, 1075 bp, Prototheca moriformis
ggccgacaggacgcgcgtcaaaggtgctgggcgtgtatgccctggtcggcaggtcgttgctgttgctgcgctcgtggttccgcaaccctgattttggcgtcttattctggcgtggcaagcgctgacgcccgcgagccgggccggcggcgatgcggtgtctcacggctgccgagctccaagggaggcaagagcgcccggatcagctgaagggctttacacgcaaggtacagccgctcctgcaaggctgcgtggtggacttgaacctgtaggtcctctgctgaagttcctccactacctcaccaggcccagcagaccaaagcacaggcttttcaggtccgtgtcatccactctaaaacactcgactacgacctactgatggccctagattcttcatcaacaatgcctgagacacttgctcagaattgaaactccctgaagggaccaccagaggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgcggcgcctttcttgcgataatttatgcaatggactgctctgcaaatttctgggtctgtcgccaaccctaggatcagcggcgtaggatttcgtaatcattcgtcctgatggggagctaccgactaccctaatatcagcccggctgcctgacgccagcgtccacttttgcgtacacattccattcgtgcccaagacatttcattgtggtgcgaagcgtccccagttacgctcacctgtttcccgacctccttactgttctgtcgacagagcgggcccacaggccggtcgcagcc

SEQ ID NO: 61 - DNA, 772 bp, Prototheca moriformis
tcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcggggctggcgggaaaacaggcttcgtgtgctcaggttatgggaggtgcaggacagctcattaaacgccaacaatcgcacaattcatggcaagctaatcagttatttcccattaacgagctataattgtcccaaaattctggtctaccgggggtgatccttcgtgtacgggcccttccctcaaccctaggtatgcgcacatgcggtcgccgcgcaacgcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggtgtaggatttcgtaatcattcgtcctgatggggagctaccgactgccctagtatcagcccgactgcctgacgccagcgtccacttttgtgcacacattccattcgtgcccaagacatttcattgtggtgcgaagcgtccccagttacgctcacctgatccccaacctccttattgttctgtcgacagagtgggcccagaggccggtcgcagcc

SEQ ID NO: 62 - DNA, 991 bp, Prototheca moriformis
cgaaggggtctgcatcgattcgcgcggtctggaggccagcgtgactgctcgcgaaaatgctctgccgtgtcgggctctggctggggcggccagagatctcaccgtgccacacgcaactgccgcactctgtgcccgccacctggcgcgcacatgcgacctcttccccgtcataccctctcctcatgtgatctttccacacgagtgacgcaggtgcgcggagtggagggaatcaggacgttttcaaggtacctgctcgagccgtaccaacagctgccgcccggcaaggaagagatcgaggcagagattgcccggctggaggcccggataacggagctcaagagcaagctgtccgagtgagaccgcccaggtgcacgtgtcgactcgctatgacatgtactcgacacaacatgaggaattcatcgaatttgtaggaagcgggcattggtacgggagtgggaaagcgaaaaaacctccctccggcagtgccatctgccggagtcgaacgttgatagggttctcgtgacagggtgtgacctctcagccttgcatcaattaaacgctatagacattatcagtaaccgtgaatcccgcattggatgccacccgcgcgaccattggggacctgcattacagatctaggtgagatgacagcgaggcaacttcggcccgcggcccagcttgcggcgcaccaatattggtcacgggaagccacacaccgaccataaatgaatacttgtaagctatgtcaaccgatcaatggcgtcgaaagtgtgccacgaggatccatctggcggggcggcgtggcgcacaagcgcagtcgcaatttctcggacccatctgacctaggcccagcgccgcgggagaaatccccggcgggtcctccacgcagtaaccctaatgagtatcgagcgccgaccatttacaccatcgcccccgaaatccttccgacattattattatcttttagatcttggaacagactctgccaacc

SEQ ID NO: 63 - DNA, 1347 bp, Prototheca moriformis
agagagcggaggtggggttgtgaggtggggttgctgaccaggagctcgcgtcgccgagcgcgactcgcacacggtccagttacccccccctccgcccaaacgcaagcctcccatcttgatgcctttccggccacctatactatttcttagttcgctgtaacatccagaccgtcctgaataataacaatgccctgtgtcaagtgcattcctaaaaaaattctgtcccaaccaacaatcccacctgaaataccaccagccctgcccagtacactcttccaataccatctccctacctccacgcgcaagcgacccccatgcgcgaccaggctcgaaagtgatttatgacttgagacgagcgagtggcggcgcggtcgactgccttttcatcacgtgccgtacgtcggcgaccgctagggctttgcacggcaacgcacggcttcgccaacccgaccagccaggacctcgactactctaccgcgaattcgcctcaagaagtcgccaaatgtgccatacaccattccttacagcactgttcaaacttgatgccaattttgacattcgggttgctcgttggctgcgcccacatcggccgtgagtgcagcaggcgggatcggacacggaggacgcggcgtcacgccccgaacgcagcccgtaactctacatcaacacgacgtgttgcgtaatcccgcccggctgcgcatcgtgccaacccattcgcgatggatggtcggaaaatggtgtgccaactgccctgagggaggctctcgcgaaacgggcacgtccctgaaaccgaaactgtggccttgtcgtcggccacgcaagcacgtggaccctaaacaccaagaaaatcagtaaacaaggttgacatcctctacgggcgaattgtttgcccaacccttcatcgcacactgccattataatgcatctagctcggcgacaagtttagaaaaggcaggctgcattgttccatttcgccgtggcggcgtgggtgcccattttacgaggtttgggctcccgggcagcgaccgagccaggtcgagtccctctcgcccgtcgacaatgttgcgaaccccacaagcggctaacaacaacttgatggtacctgtacactgccaattccttcttccccggccgaggtttacacgtgatggccatggcttcgcattcaggccgacttcccattccgactttccagagggtccgcggacgctgggggttggctgcctgaggcccaccctttgttccccgcgtcccgacaaacacaattgcgttacataagggggagccgcccccgttcagagtgcagaaatctttcactatattttccagtcgtcagcgaaatcaagt

SEQ ID NO: 64 - DNA, 1180 bp, Prototheca moriformis
gatggtggggtgtctgccttgggctgggtgatggaggctggtggtgcgcgggtttcctgatgcattctatctacgcagtgtcatggtgtccattccacacaccagtacacccttacactaaggatccatccctccttccctcttcaggactacatggaccccacgagctaccgaccgggctttctcaaaaacgtcaaggtcatgtttgacatgcgggacgtggtggacgacgtgcaaggtgcgtccggagtgcgcgcaaatgagcaagtcgggcaatgtgtcggggtgggcaccggggctggagatccgcgatccccgagaaaacgccgtaccaccccccgcgctattccctcgattgcgcgcagatgtggtgaccgacacgggggacaacctggcggacatggggcgccggacctggaagcacgccaagtcgcacacggggaggctcgtgcagtcccccccatcgtacctcaagggtctctttggtcgcgatccaaagtacgctggtggcatggcatgcccgaaatgaacatcatgtgtgatctccgattgccaatggccacctccacggaccaccttgcaggcggaagcgcaatccagggcccgagcctgacgaggacggagactcctcgtccagcgcggggtccccgacccgacgcagcagccgacccctgctaacccggcaacgatcggaccagcaaccttgctgtagttccgatccgtgatgacgggcattgccgccgctcgatccgctttgatgactgtctattatttgcgcggagccccctcggaaccctaccccgctcttgcaagccccttgcatcggagatcctcgtgcgcccgccatgaccccactggattgcccaacatccttctttatcgtgtaaaatgtgattcctcggctgcaatcgactggccttcgcttctggccccaagagggctcgaacgtgcggcagcgagggcgctgacacacccaagccctagggctttcaacgtcggctgccaggccggatagggggatcgcctcctttccaccacccacctacgagggattcgagtcggcttccagctcagctattcggccgcgcccccggccctgcagacgtcctccagtttccgaacaggtcgctctcagaacacctgccgcggctgcgatacggcaggctctcaaagcgtcgac

SEQ ID NO: 65 - DNA, 1263 bp, Prototheca moriformis
cgcgtggagcggtgcgtgcggatgccgcgcgcctgccaaggccttttgtatgcctggcctgggaagtttcctgactgaagcatcttcaagatgctctctcacgaccagcgacaccaacaccgtcactttttgcccctcctgccgcaggtgccactttctactttgacgtcttctccaggcggtacattgcgggactgagcgccaattcggccaagaacagcgctgtcgacttgaggaggcaggggtccgtcgactctgccgagtgacacgccttcgacccgactgtactacggcctgctgaagagtgggtctcgccggccggcgtgaccggccctgtgcccacaatcgaccatctattcgctccttgtcatctggcgccgtcaattgcccgcgacttgacggcaactggctcgatcgagtcgtattgaaaaagcacgttttgtcctacagggccgcggtccgttaccaacgtggttctcgttaggttttcgtcgggcggtggtgcgcgaactgtccgatgccatcccggcaaaccccagcaaggtcgccagtctggttctgacgcaatagagtgcgttttgggccagtctaaaaattcgtctggcatgacgtggctccacatcgtacccggagcctgccttggtaatgtgaggcaccggtgccaactccattatggcaggcatcgagcgcgcaggtgagtacatgaccttccgtgaattgggaaggcgagcttgtgtaacgcctgcgatcgtgccagtgaggcatcgtaaactcaaaatattttgtagaaagtgtctgatgcctggtgaggctgcgtagggcaagggcaagcccttggcagatgggtaatgggtccggacctcacaacagcaaccccgcgtcccccttagggcccctgaggctcgatggcagggccagcgagcccgcggccaaagggcgccatcccacggtcgcccaacgactccacgggtcctatacctcatcttgaatggcactaaaaactatagaatatcgggcactggtgggcgtctggggtacagctggccgagcgcagtggcaaaccctaggtcccgcctcaagggcgattcccgggtcaatgacacgcaagcaagatcacatggcgcggtccgcctcgcggctccacacccaggccctagtttcgcaacccataaatatcgccccgataccatcataagccagcaaataattttttatcagagttccaaacctcctcagctgtgggaaaccagcccactctgaacg

SEQ ID NO: 66 - DNA, 1400 bp, Prototheca moriformis
ccgagcagttcatggccaagtacaaggactagagaccggaggtcggtaggctgaatggagctggcgtcgtcgtgcgcgacgtgcacgcgatgcgatactacgaccccacaaacgcatgcctcccatcttgatgcctttccggccatttatactatttctcatttcgctgtaacatcttgaataatagaattgccctgtgtcaagtggattccaagaaatattctgtcccaacaaaacaacccaacctgaaaacaacctcaaataccaccagccctgcccacctgcccagtacacttttccaataccatctccctaccttcacgcgcaagcggcacccatgcgcgaccaggctcgaaaggatttcacgactcaggacgagcgagtggcggcgcgaccgcctgcctgttcgtcacgtgccgtacgtcggcgaccgctagagctttgcctggcaacccccggcttcgtcaacccggccagccaggatctcgaccactctaccgcgaaatcgcctcaagaagtcgccaaaagtgccgtacaccatgcttcgcagcgctgttcaaacttgatgccaatcttgacaatcaggttgctcgttggctgcgtccacatcggccgtgattgcagcaggcggggatcggacacggaggacgcggcgtcacgccgcgaacgcagcccgtaactctacatcaacgcgatatgttgcgtaatcccgcccggctgcgcattgtgacaacccattcgcgatggatggtcggaaaatggtgtgccaactgccctgagggactctctcgcgaaacgggcacgtccctgtatccgaaactgtggcatggccttgtcgaccacgcaagcacgtggaccctaacaccacgaaaataagtaaaaaaggttgacatcctctacgagcgaattgtttgctcgacccttcatcgcacactgtcattataatgcatctagctcggcgacaagtttaaaaaaggcaggctgcattattccattttgccgtggcggcatgggtgcccattttatgaggtttgggctcttgggcagcgaccgagccaggttgagtccctctcgcccgtcgacaacgttccaaagcccataagtggctaataaacaacttgatggtacctgtacactgccagttccttcttccccggccgaggtttacacgtgatggccatggcttcgcgtttcaggctgacttcccattccgactttccagagggtccgcggacgccgggggttggctgcgtgaggcccaccccttgttccccgcgtcccgacaaacacaattgcgttacataagggggaagccgccccccgttcagagtgcaaacatctttcattatatttttcagtcgtcagcgaaatcaagtatgtcgctgacaggcatgaaggcc

SEQ ID NO: 67 - DNA, 6490 bp, Prototheca moriformis
gctcttcggccgccgccactcctgctcgagcgcgcccgactcgcgctccgcctgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcatcgaatttgtaggaagcgggcattggtacgggagtgggaaagcgaaaaaacctccctccggcagtgccatctgccggagtcgaacgttgatagggttctcgtgacagggtgtgacctctcagccttgcatcaattaaacgctatagacattatcagtaaccgtgaatcccgcattggatgccacccgcgcgaccattggggacctgcattacagatctaggtgagatgacagcgaggcaacttcggcccgcggcccagcttgcggcgcaccaatattggtcacgggaagccacacaccgaccataaatgaatacttgtaagctatgtcaaccgatcaatggcgtcgaaagtgtgccacgaggatccatctggcggggcggcgtggcgcacaagcgcagtcgcaatttctcggacccatctgacctaggcccagcgccgcgggagaaatccccggcgggtcctccacgcagtaaccctaatgagtatcgagcgccgaccatttacaccatcgccccccgaaatccttccgacattattattatcttttagatcttggaacagactctgccaaccactagtatggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgactcgagttaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctccttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 68 - DNA, 20 bp, Cinnamomum camphora
taccccgcctggggcgacac

SEQ ID NO: 69 - DNA, 20 bp, Cinnamomum camphora
cttgctcaggcggcgggtgc

SEQ ID NO: 70 - DNA, 20 bp, Prototheca moriformis
ccggatctcggccagggcta

SEQ ID NO: 71 - DNA, 20 bp, Prototheca moriformis
tcgatgtcgtgcaccgtcgc

SEQ ID NO: 72 - DNA, 1092 bp, Prototheca moriformis
gctcttcgggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcgccggtgcctacgtgggtcaagtatggcgtcatgtggccgctctactggttcttccaggtgtgtgtgagggttgtggttgcccgtatcgaggtcctggtggcgcgcatgggggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgcc

SEQ ID NO: 73 - DNA, 1400 bp, Prototheca moriformis
caattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggagcatcgaggtggtcatctccgacctcgcgttggtggcggtgctcagcgggctcagcgtgctgggccgcaccatgggctgggcctggctggtcaagacctacgtggtgccctacatgatcgtgaacatgtggctggtgctcatcacgctgctccagcacacgcacccggccctgccgcactacttcgagaaggactgggactggctacgcggcgccatggccaccgtcgaccgctccatgggcccgcccttcatggacagcatcctgcaccacatctccgacacccacgtgctgcaccacctcttcagcaccatcccgcactaccacgccgaggaggcctccgccgccatccggcccatcctgggcaagtactaccaatccgacagccgctgggtcggccgcgccctgtgggaggactggcgcgactgccgctacgtcgtccccgacgcgcccgaggacgactccgcgctctggttccacaagtgagcgcgcctgcgcgaggacgcagaacaacgctgccgccgtgtcttttgcacgcgcgactccggcgcttcgctggtggcacccccataaagaaaccctcaattctgtttgtggaagacacggtgtacccccacccacccacctgcacctctattattggtattattgacgcgggagtgggcgttgtaccctacaacgtagcttctctagttttcagctggctcccaccattgtaaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 74 - DNA, 4091 bp, Prototheca moriformis
gctcttcgggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcgccggtgcctacgtgggtcaagtatggcgtcatgtggccgctctactggttcttccaggtgtgtgtgagggttgtggttgcccgtatcgaggtcctggtggcgcgcatgggggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggagcatcgaggtggtcatctccgacctcgcgttggtggcggtgctcagcgggctcagcgtgctgggccgcaccatgggctgggcctggctggtcaagacctacgtggtgccctacatgatcgtgaacatgtggctggtgctcatcacgctgctccagcacacgcacccggccctgccgcactacttcgagaaggactgggactggctacgcggcgccatggccaccgtcgaccgctccatgggcccgcccttcatggacagcatcctgcaccacatctccgacacccacgtgctgcaccacctcttcagcaccatcccgcactaccacgccgaggaggcctccgccgccatccggcccatcctgggcaagtactaccaatccgacagccgctgggtcggccgcgccctgtgggaggactggcgcgactgccgctacgtcgtccccgacgcgcccgaggacgactccgcgctctggttccacaagtgagcgcgcctgcgcgaggacgcagaacaacgctgccgccgtgtcttttgcacgcgcgactccggcgcttcgctggtggcacccccataaagaaaccctcaattctgtttgtggaagacacggtgtacccccacccacccacctgcacctctattattggtattattgacgcgggagtgggcgttgtaccctacaacgtagcttctctagttttcagctggctcccaccattgtaaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 75 - DNA, 510 bp, Prototheca moriformis
gctcttccgcctggagctggtgcagagcatgggtcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtacc

SEQ ID NO: 76 - DNA, 1186 bp, Prototheca moriformis
caattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaggatcgtagagctccagccacggcaacaccgcgcgcctggcggccgagcacggcgacaagggcctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgccgtcgccgagaagatcgacgtctacgacgccgaggactactgccgcatcctggagcacctcaacgcgcgctggaaggtggacgagcgccaggtcagcggccaggccgccgcggaccaggagtacgttctgggcctgccccagcgcttccggaaactcgccgagaagaccgccgccaagcgcaagcgcgtcgcgcgcaggcccgtcgccttctcctggagagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 77 - DNA, 3615 bp, Prototheca moriformis
gctcttccgcctggagctggtgcagagcatgggtcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaggatcgtagagctccagccacggcaacaccgcgcgcctggcggccgagcacggcgacaagggcctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgccgtcgccgagaagatcgacgtctacgacgccgaggactactgccgcatcctggagcacctcaacgcgcgctggaaggtggacgagcgccaggtcagcggccaggccgccgcggaccaggagtacgttctgggcctgccccagcgcttccggaaactcgccgagaagaccgccgccaagcgcaagcgcgtcgcgcgcaggcccgtcgccttctcctggagagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 78 - DNA, 511 bp, Prototheca moriformis
gctcttcccgcctggagctggtgcagagcatggggcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtacc

SEQ ID NO: 79 - DNA, 761 bp, Prototheca moriformis
cagccacggcaacaccgcgcgccttgcggccgagcacggcgacaagaacctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactactgccgcatcctggagcacctcaacgcgcgctggaaggtggacgagcgccaggtcagcggccaggccgccgcggaccaggagtacgtcctgggcctgccccagcgcttccggaaactcgccgagaagaccgccgccaagcgcaagcgcgtcgcgcgcaggcccgtcgccttctcctggagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 80 - DNA, 3599 bp, Prototheca moriformis
gctcttcccgcctggagctggtgcagagcatggggcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggacagccacggcaacaccgcgcgccttgcggccgagcacggcgacaagaacctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactactgccgcatcctggagcacctcaacgcgcgctggaaggtggacgagcgccaggtcagcggccaggccgccgcggaccaggagtacgtcctgggcctgccccagcgcttccggaaactcgccgagaagaccgccgccaagcgcaagcgcgtcgcgcgcaggcccgtcgccttctcctggagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 81 - DNA, 2933 bp, Artificial Sequence
  synthetic polynucleotide
agagagcggaggtggggttgtgaggtggggttgctgaccaggagctcgcgtcgccgagcgcgactcgcacacggtccagttacccccccctccgcccaaacgcaagcctcccatcttgatgcctttccggccacctatactatttcttagttcgctgtaacatccagaccgtcctgaataataacaatgccctgtgtcaagtgcattcctaaaaaaattctgtcccaaccaacaatcccacctgaaataccaccagccctgcccagtacactcttccaataccatctccctacctccacgcgcaagcgacccccatgcgcgaccaggctcgaaagtgatttatgacttgagacgagcgagtggcggcgcggtcgactgccttttcatcacgtgccgtacgtcggcgaccgctagggctttgcacggcaacgcacggcttcgccaacccgaccagccaggacctcgactactctaccgcgaattcgcctcaagaagtcgccaaatgtgccatacaccattccttacagcactgttcaaacttgatgccaattttgacattcgggttgctcgttggctgcgcccacatcggccgtgagtgcagcaggcgggatcggacacggaggacgcggcgtcacgccccgaacgcagcccgtaactctacatcaacacgacgtgttgcgtaatcccgcccggctgcgcatcgtgccaacccattcgcgatggatggtcggaaaatggtgtgccaactgccctgagggaggctctcgcgaaacgggcacgtccctgaaaccgaaactgtggccttgtcgtcggccacgcaagcacgtggaccctaaacaccaagaaaatcagtaaacaaggttgacatcctctacgggcgaattgtttgcccaacccttcatcgcacactgccattataatgcatctagctcggcgacaagtttagaaaaggcaggctgcattgttccatttcgccgtggcggcgtgggtgcccattttacgaggtttgggctcccgggcagcgaccgagccaggtcgagtccctctcgcccgtcgacaatgttgcgaaccccacaagcggctaacaacaacttgatggtacctgtacactgccaattccttcttccccggccgaggtttacacgtgatggccatggcttcgcattcaggccgacttcccattccgactttccagagggtccgcggacgctgggggttggctgcctgaggcccaccctttgttccccgcgtcccgacaaacacaattgcgttacataagggggagccgcccccgttcagagtgcagaaatctttcactatattttccagtcgtcagcgaaatcaagtactagtatggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgactcgagttaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctt

SEQ ID NO: 82 - DNA, 726 bp, Artificial Sequence
  synthetic polynucleotide
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtacc

SEQ ID NO: 83 - DNA, 3635 bp, Artificial Sequence
  synthetic polynucleotide
ctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctt

SEQ ID NO: 84 - DNA, 749 bp, Artificial Sequence
  synthetic polynucleotide
gagctccttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 85 - DNA, 30 bp, Artificial Sequence
  synthesized primer
ggaggaattcggccgacaggacgcgcgtca

SEQ ID NO: 86 - DNA, 28 bp, Artificial Sequence
  synthesized primer
ggagactagtggctgcgaccggcctgtg

SEQ ID NO: 87 - DNA, 31 bp, Artificial Sequence
  synthesized primer
ggaggaattctcaccagcggacaaagcaccg

SEQ ID NO: 88 - DNA, 29 bp, Artificial Sequence
  synthesized primer
ggagactagtggctgcgaccggcctctgg

SEQ ID NO: 89 - DNA, 1065 bp, Artificial Sequence
  synthetic polynucleotide
ggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagcc

SEQ ID NO: 90 - DNA, 6981 bp, Cinnamomum camphora
gctcttcggccgccgccactcctgctcgagcgcgcccgactcgcgctccgcctgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgactcgagttaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctccttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 91 - DNA, 1152 bp, Cinnamomum camphora
atggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtga

SEQ ID NO: 92 - DNA, 1052 bp, Umbellularia californica
ggcgcgcccccgactggtccatgctgttcgccgtgatcaccaccatcttcagcgccgccgagaagcagtggaccaacctggagtggaagcccaagcccaagctgccccagctgctggacgaccacttcggcctgcacggcctggtgttccgccgcaccttcgccatccgctcctacgaggtgggccccgaccgcagcacctccatcctggccgtgatgaaccacatgcaggaggccaccctgaaccacgccaagagcgtgggcatcctgggcgacggcttcggcaccaccctggagatgtccaagcgcgacctgatgtgggtggtgcgccgcacccacgtggccgtggagcgctaccccacctggggcgacaccgtggaggtggagtgctggatcggcgccagcggcaacaacggcatgcgccgcgacttcctggtgcgcgactgcaagaccggcgagatcctgacccgctgcacctccctgagcgtgctgatgaacacccgcacccgccgcctgagcaccatccccgacgaggtgcgcggcgagatcggccccgccttcatcgacaacgtggccgtgaaggacgacgagatcaagaagctgcagaagctgaacgactccaccgccgactacatccagggcggcctgaccccccgctggaacgacctggacgtgaaccagcacgtgaacaacctgaagtacgtggcctgggtgttcgagaccgtgcccgacagcatcttcgagtcccaccacatcagctccttcaccctggagtaccgccgcgagtgcacccgcgactccgtgctgcgcagcctgaccaccgtgagcggcggcagctccgaggccggcctggtgtgcgaccacctgctgcagctggagggcggcagcgaggtgctgcgcgcccgcaccgagtggcgccccaagctgaccgactccttccgcggcatcagcgtgatccccgccgagccccgcgtgatggactacaaggaccacgacggcgactacaaggaccacgacatcgactacaaggacgacgacgacaagtgactcgag

SEQ ID NO: 93 - DNA, 1031 bp, Ulmus americana
ggcgcgcccagctgcccgactggagcatgctgctggccgcgatcaccaccctgttcctggcggccgagaagcagtggatgatgctggactggaagcccaagcgccccgacatgctggtggaccccttcggcctgggccgcttcgtgcaggacggcctggtgttccgcaacaacttcagcatccgcagctacgagatcggcgcggaccgcaccgccagcatcgagaccctgatgaaccacctgcaggagaccgccctgaaccacgtgaagagcgtgggcctgctggaggacggcctgggcagcacccgcgagatgagcctgcgcaacctgatctgggtggtgaccaagatgcaggtggcggtggaccgctaccccacctggggcgacgaggtgcaggtgagcagctgggcgaccgccatcggcaagaacggcatgcgccgcgagtggatcgtgaccgacttccgcaccggcgagaccctgctgcgcgccaccagcgtgtgggtgatgatgaacaagctgacccgccgcatcagcaagatccccgaggaggtgtggcacgagatcggccccagcttcatcgacgcgccccccctgcccaccgtggaggacgacggccgcaagctgacccgcttcgacgagagcagcgccgacttcatccgcaagggcctgaccccccgctggagcgacctggacatcaaccagcacgtgaacaacgtgaagtacatcggctggctgctggagagcgcgccccccgagatccacgagagccacgagatcgccagcctgaccctggagtaccgccgcgagtgcggccgcgacagcgtgctgaacagcgccaccaaggtgagcgacagcagccagctgggcaagagcgccgtggagtgcaaccacctggtgcgcctgcagaacggcggcgagatcgtgaagggccgcaccgtgtggcgccccaagcgccccctgtacaacgacggcgccgtggtggacgtgcccgccaagaccagcgatgacgatgacaagctgggatgactcgag

SEQ ID NO: 94 - DNA, 1182 bp, Cuphea hookeriana
actagtatggctatcaagacgaacaggcagcctgtggagaagcctccgttcacgatcgggacgctgcgcaaggccatccccgcgcactgtttcgagcgctcggcgcttcgtgggcgcgcccagctgcccgactggagccgcctgctgaccgccatcaccaccgtgttcgtgaagtccaagcgccccgacatgcacgaccgcaagtccaagcgccccgacatgctggtggacagcttcggcctggagtccaccgtgcaggacggcctggtgttccgccagtccttctccatccgctcctacgagatcggcaccgaccgcaccgccagcatcgagaccctgatgaaccacctgcaggagacctccctgaaccactgcaagagcaccggcatcctgctggacggcttcggccgcaccctggagatgtgcaagcgcgacctgatctgggtggtgattaagatgcagatcaaggtgaaccgctaccccgcctggggcgacaccgtggagatcaacacccgcttcagccgcctgggcaagatcggcatgggccgcgactggctgatctccgactgcaacaccggcgagatcctggtgcgcgccaccagcgcctacgccatgatgaaccagaagacccgccgcctgtccaagctgccctacgaggtgcaccaggagatcgtgcccctgttcgtggacagccccgtgatcgaggactccgacctgaaggtgcacaagttcaaggtgaagaccggcgacagcatccagaagggcctgacccccggctggaacgacctggacgtgaaccagcacgtgtccaacgtgaagtacatcggctggatcctggagagcatgcccaccgaggtgctggagacccaggagctgtgctccctggccctggagtaccgccgcgagtgcggccgcgactccgtgctggagagcgtgaccgccatggaccccagcaaggtgggcgtgcgctcccagtaccagcacctgctgcgcctggaggacggcaccgccatcgtgaacggcgccaccgagtggcgccccaagaacgccggcgccaacggcgccatctccaccggcaagaccagcaacggcaactccgtgtccatggactacaaggaccacgacggcgactacaaggaccacgacatcgactacaaggacgacgacgacaagtgactcgag

SEQ ID NO: 95 - DNA, 20 bp, Umbellularia californica
ctgggcgacggcttcggcac

SEQ ID NO: 96 - DNA, 20 bp, Umbellularia californica
aagtcgcggcgcatgccgtt

SEQ ID NO: 97 - DNA, 20 bp, Ulmus americana
cccagctgctcacctgcacc

SEQ ID NO: 98 - DNA, 26 bp, Ulmus americana
cacccaaggccaacggcagcgccgtg

SEQ ID NO: 99 - DNA, 20 bp, Cuphea hookeriana
taccccgcctggggcgacac

SEQ ID NO: 100 - DNA, 20 bp, Cuphea hookeriana
agcttggacaggcggcgggt

SEQ ID NO: 101 - DNA, 20 bp, Prototheca moriformis
tcacttcatgccggcggtcc

SEQ ID NO: 102 - DNA, 20 bp, Prototheca moriformis
gcgctcctgcttggctcgaa

SEQ ID NO: 103 - DNA, 733 bp, Artificial Sequence
  synthetic polynucleotide
gctcttcgagacgtggtctgaatcctccaggcgggtttccccgagaaagaaagggtgccgatttcaaagcagagccatgtgccgggccctgtggcctgtgttggcgcctatgtagtcaccccccctcacccaattgtcgccagtttgcgcaatccataaactcaaaactgcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcgccggtgcctacgtgggtcaagtatggcgtcatgtggccgctctactggttcttccaggtgtgtgtgagggttgtggttgcccgtatcgaggtcctggtggcgcgcatgggggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgggtacc

SEQ ID NO: 104 - DNA, 739 bp, Artificial Sequence
  synthetic polynucleotide
ccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgagcgcatcgaggtggtcatctccgacctggcgctggtggcggtgctcagcgggctcagcgtgctgggccgcaccatgggctgggcctggctggtcaagacctacgtggtgccctacctgatcgtgaacatgtggctcgtgctcatcacgctgctccagcacacgcacccggcgctgccgcactacttcgagaaggactgggactggctgcgcggcgccatggccaccgtggaccgctccatgggcccgcccttcatggacaacatcctgcaccacatctccgacacccacgtgctgcaccacctcttcagcaccatcccgcactaccacgccgaggaggcctccgccgccatcaggcccatcctgggcaagtactaccagtccgacagccgctgggtcggccgcgccctgtgggaggactggcgcgactgccgctacgtcgtcccggacgcgcccgaggacgactccgcgctctggttccacaagtgagtgagtgagaagagc

SEQ ID NO: 105 - DNA, 2327 bp, Saccharomyces cerevisiae
ctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatgga

SEQ ID NO: 106 - DNA, 735 bp, Artificial Sequence
  synthetic polynucleotide
gctcttcgaggggctggtctgaatccttcaggcgggtgttacccgagaaagaaagggtgccgatttcaaagcagacccatgtgccgggccctgtggcctgtgttggcgcctatgtagtcaccccccctcacccaattgtcgccagtttgcgcactccataaactcaaaacagcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgggtacc

SEQ ID NO: 107 - DNA, 739 bp, Artificial Sequence; identical to SEQ ID NO: 104
  synthetic polynucleotide

SEQ ID NO: 108 - protein, 471 aa, Saccharomyces carlbergensis
MFAFYFLTACISLKGVFGVSPSYNGLGLTPQMGWDNWNTFACDVSEQLLLDTADRISDLGLKDMGYKYIILDDCWSSGRDSDGFLVADEQKFPNGMGHVADHLHNNSFLFGMYSSAGEYTCAGYPGSLGREEEDAQFFANNRVDYLKYDNCYNKGQFGTPEISYHRYKAMSDALNKTGRPIFYSLCNWGQDLTFYWGSGIANSWRMSGDVTAEFTRPDSRCPCDGDEYDCKYAGFHCSIMNILNKAAPMGQNAGVGGWNDLDNLEVGVGNLTDDEEKAHFSMWAMVKSPLIIGANVNNLKASSYSIYSQASVIAINQDSNGIPATRVWRYYVSDTDEYGQGEIQMWSGPLDNGDQVVALLNGGSVSRPMNTTLEEIFFDSNLGSKKLTSTWDIYDLWANRVDNSTASAILGRNKTATGILYNATEQSYKDGLSKNDTRLFGQKIGSLSPNAILNTTVPAHGIAFYRLRPSS

SEQ ID NO: 109 - protein, 18 aa, Saccharomyces carlbergensis
MFAFYFLTACISLKGVFG

SEQ ID NO: 110 - DNA, 3183 bp, Saccharomyces carlbergensis
gcggccgcgtggacgagggctacaaccccgcctacggcgcgcgcccgctgcgccgcgccatcatgcgcctgctggaggacgcgctggccgagcgcatgctcgccggcgacgtcaaggagggcgactcggtcatcatggacgtcgatggcgatggcgccatcagcgtcctcaacggagaccgcacccacaccaccaccatcgactcctccccggcgggcatctcgtagacgcgagagggagggagggaggattttcagagggagatgagacgaggactgggccgggggccttggggcgctgctggagcgtggtgagagcgcggcggacgtgccttttcttcttccgtgcgcgcgctcttggccattgatccccgattcgcgcccgcatccccccactgcccccatcatcttgcctgttgtcgtggcactgacataaaccccctgcgctgcgctgctccgctactattgatataggtctcacgcgccaatcttttttgctccgggtaaccgtctggacgccagaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatgttcgcgttctacttcctgacggcctgcatctccctgaagggcgtgttcggcgtctccccctcctacaacggcctgggcctgacgccccagatgggctgggacaactggaacacgttcgcctgcgacgtctccgagcagctgctgctggacacggccgaccgcatctccgacctgggcctgaaggacatgggctacaagtacatcatcctggacgactgctggtcctccggccgcgactccgacggcttcctggtcgccgacgagcagaagttccccaacggcatgggccacgtcgccgaccacctgcacaacaactccttcctgttcggcatgtactcctccgcgggcgagtacacgtgcgccggctaccccggctccctgggccgcgaggaggaggacgcccagttcttcgcgaacaaccgcgtggactacctgaagtacgacaactgctacaacaagggccagttcggcacgcccgagatctcctaccaccgctacaaggccatgtccgacgccctgaacaagacgggccgccccatcttctactccctgtgcaactggggccaggacctgaccttctactggggctccggcatcgcgaactcctggcgcatgtccggcgacgtcacggcggagttcacgcgccccgactcccgctgcccctgcgacggcgacgagtacgactgcaagtacgccggcttccactgctccatcatgaacatcctgaacaaggccgcccccatgggccagaacgcgggcgtcggcggctggaacgacctggacaacctggaggtcggcgtcggcaacctgacggacgacgaggagaaggcgcacttctccatgtgggccatggtgaagtcccccctgatcatcggcgcgaacgtgaacaacctgaaggcctcctcctactccatctactcccaggcgtccgtcatcgccatcaaccaggactccaacggcatccccgccacgcgcgtctggcgctactacgtgtccgacacggacgagtacggccagggcgagatccagatgtggtccggccccctggacaacggcgaccaggtcgtggcgctgctgaacggcggctccgtgtcccgccccatgaacacgaccctggaggagatcttcttcgactccaacctgggctccaagaagctgacctccacctgggacatctacgacctgtgggcgaaccgcgtcgacaactccacggcgtccgccatcctgggccgcaacaagaccgccaccggcatcctgtacaacgccaccgagcagtcctacaaggacggcctgtccaagaacgacacccgcctgttcggccagaagatcggctccctgtcccccaacgcgatcctgaacacgaccgtccccgcccacggcatcgcgttctaccgcctgcgcccctcctcctgacaattgaagcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcagaatagtatcgggtgatgcgaagtcagaaccaggcagggcctgtcgcctgaggtggcaacgatgggaagcaatcaatctgggtacagtcgtccgcacgatcccgtgatctcccccaccgacacctatccccgcccatcccggcccaccctttcagtcccctcagcatgcattgtgcaccgcgacaaagcatgtctgctcgtgcactggttcaggccacggcgcaccgagtcctcgcccttcgcagagtgatcaccctccccggaaccagccacgctcgctgctgcgggccgatcagccgcgcgcactccctgcaactagggacaactcaggcaaccacgcgcctcacaagcatggccgccgtggcatccaacccgctcgtgacggtgggtgcgcaagtgccaggggcctcgtcgtcacggcgtgcatcctcgagggatgcgatccggcaactatatgtcgtttatctccccaccaatcacaggatgagcccctgtctaga

SEQ ID NO: 111 - DNA, 1416 bp, Saccharomyces carlbergensis
atgttcgcgttctacttcctgacggcctgcatctccctgaagggcgtgttcggcgtctccccctcctacaacggcctgggcctgacgccccagatgggctgggacaactggaacacgttcgcctgcgacgtctccgagcagctgctgctggacacggccgaccgcatctccgacctgggcctgaaggacatgggctacaagtacatcatcctggacgactgctggtcctccggccgcgactccgacggcttcctggtcgccgacgagcagaagttccccaacggcatgggccacgtcgccgaccacctgcacaacaactccttcctgttcggcatgtactcctccgcgggcgagtacacgtgcgccggctaccccggctccctgggccgcgaggaggaggacgcccagttcttcgcgaacaaccgcgtggactacctgaagtacgacaactgctacaacaagggccagttcggcacgcccgagatctcctaccaccgctacaaggccatgtccgacgccctgaacaagacgggccgccccatcttctactccctgtgcaactggggccaggacctgaccttctactggggctccggcatcgcgaactcctggcgcatgtccggcgacgtcacggcggagttcacgcgccccgactcccgctgcccctgcgacggcgacgagtacgactgcaagtacgccggcttccactgctccatcatgaacatcctgaacaaggccgcccccatgggccagaacgcgggcgtcggcggctggaacgacctggacaacctggaggtcggcgtcggcaacctgacggacgacgaggagaaggcgcacttctccatgtgggccatggtgaagtcccccctgatcatcggcgcgaacgtgaacaacctgaaggcctcctcctactccatctactcccaggcgtccgtcatcgccatcaaccaggactccaacggcatccccgccacgcgcgtctggcgctactacgtgtccgacacggacgagtacggccagggcgagatccagatgtggtccggccccctggacaacggcgaccaggtcgtggcgctgctgaacggcggctccgtgtcccgccccatgaacacgaccctggaggagatcttcttcgactccaacctgggctccaagaagctgacctccacctgggacatctacgacctgtgggcgaaccgcgtcgacaactccacggcgtccgccatcctgggccgcaacaagaccgccaccggcatcctgtacaacgccaccgagcagtcctacaaggacggcctgtccaagaacgacacccgcctgttcggccagaagatcggctccctgtcccccaacgcgatcctgaacacgaccgtccccgcccacggcatcgcgttctaccgcctgcgcccctcctcctga

SEQ ID NO: 112 - DNA, 526 bp, Artificial Sequence
  synthetic construct
gcggccgcgtggacgagggctacaaccccgcctacggcgcgcgcccgctgcgccgcgccatcatgcgcctgctggaggacgcgctggccgagcgcatgctcgccggcgacgtcaaggagggcgactcggtcatcatggacgtcgatggcgatggcgccatcagcgtcctcaacggagaccgcacccacaccaccaccatcgactcctccccggcgggcatctcgtagacgcgagagggagggagggaggattttcagagggagatgagacgaggactgggccgggggccttggggcgctgctggagcgtggtgagagcgcggcggacgtgccttttcttcttccgtgcgcgcgctcttggccattgatccccgattcgcgcccgcatccccccactgcccccatcatcttgcctgttgtcgtggcactgacataaaccccctgcgctgcgctgctccgctactattgatataggtctcacgcgccaatcttttttgctccgggtaaccgtctggacgccagaattc

SEQ ID NO: 113 - DNA, 507 bp, Artificial Sequence
  synthetic construct
gagctcagaatagtatcgggtgatgcgaagtcagaaccaggcagggcctgtcgcctgaggtggcaacgatgggaagcaatcaatctgggtacagtcgtccgcacgatcccgtgatctcccccaccgacacctatccccgcccatcccggcccaccctttcagtcccctcagcatgcattgtgcaccgcgacaaagcatgtctgctcgtgcactggttcaggccacggcgcaccgagtcctcgcccttcgcagagtgatcaccctccccggaaccagccacgctcgctgctgcgggccgatcagccgcgcgcactccctgcaactagggacaactcaggcaaccacgcgcctcacaagcatggccgccgtggcatccaacccgctcgtgacggtgggtgcgcaagtgccaggggcctcgtcgtcacggcgtgcatcctcgagggatgcgatccggcaactatatgtcgtttatctccccaccaatcacaggatgagcccctgtctaga

SEQ ID NO: 114 - DNA, 312 bp, Chlamydomonas reinhardtii
ctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaac

SEQ ID NO: 115 - DNA, 408 bp, Chlorella vulgaris
gcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctt

SEQ ID NO: 116 - protein, 747 aa, Aspergillus niger
MIGSSHAVVALGLFTLYGHSAAAPAIGASNSQTIVTNGTSFALNGDNVSYRFHVNSSTGDLISDHFGGVVSGTIPSPVEPAVNGWVGMPGRIRREFPDQGRGDFRIPAVRIRESAGYTVSDLQYVSHEVIEGKYALPGLPATFGDAQDATTLVVHLYDNYSSVAADLSYSIFPKYDAIVRSVNVTNQGPGNITIEALASISIDFPYEDLDMVSLRGDWAREANVQRSKVQYGVQGFGSSTGYSSHLHNPFLAIVDPATTESQGEAWGFNLVYTGSFSAQVEKGSQGFTRALLGFNPDQLSWNLGPGETLTSPECVAVYSDKGLGSVSRKFHRLYRNHLMKSKFATSDRPVLLNSWEGVYFDYNQSSIETLAEESAALGVHLFVMDDGWFGDKYPRVSDNAGLGDWMPNPARFPDGLTPVVQDITNLTVNGTESTKLRFGIWVEPEMVNPNSTLYHEHPEWALHAGPYPRTERRNQLVLNLALPAVQDFIIDFMTNLLQDTGISYVKWDNNRGIHETPSPSTDHQYMLGLYRVFDTLTTRFPDVLWEGCASGGGRFDAGMLQYVPQIWTSDNTDAIDRITIQFGTSLAYPPSAMGAHLSAVPNAQTGRTVPFTFRAHVAMMGGSFGLELDPATVEGDEIVPELLALAEKVNPIILNGDLYRLRLPQDSQWPAALFVSQDGAQAVLFYFQVQPNVNHAVPWVRLQGLDPKADYTVDGDQTYSGATLMNLGLQYSFDTEYGSKVVFLERQ

SEQ ID NO: 117 - protein, 28 aa, Aspergillus niger
MIGSSHAVVALGLFTLYGHSAAAPAIGA

SEQ ID NO: 118 - DNA, 2244 bp, Aspergillus niger
atgatcggctcctcccacgcggtcgtcgccctgggcctgttcaccctgtacggccactccgccgccgcgcccgccatcggcgcctccaactcccagaccatcgtcacgaacggcacctccttcgccctgaacggcgacaacgtgtcctaccgcttccacgtgaactcctccacgggcgacctgatctccgaccacttcggcggcgtggtgtccggcaccatcccctcccccgtggagcccgcggtcaacggctgggtgggcatgcccggccgcatccgccgcgagttccccgaccagggccgcggcgacttccgcatccccgcggtgcgcatccgcgagtccgccggctacaccgtctccgacctgcagtacgtgtcccacgaggtgatcgagggcaagtacgcgctgcccggcctgcccgccacgttcggcgacgcccaggacgccaccaccctggtggtgcacctgtacgacaactactcctccgtcgcggccgacctgtcctactccatcttccccaagtacgacgcgatcgtccgctccgtgaacgtgaccaaccagggccccggcaacatcaccatcgaggcgctggcctccatctccatcgacttcccctacgaggacctggacatggtgtccctgcgcggcgactgggcccgcgaggcgaacgtgcagcgctccaaggtccagtacggcgtgcagggcttcggctcctccaccggctactcctcccacctgcacaaccccttcctggcgatcgtcgaccccgcgaccaccgagtcccagggcgaggcctggggcttcaacctggtctacaccggctccttctccgcccaggtcgagaagggctcccagggcttcacgcgcgccctgctgggcttcaaccccgaccagctgtcctggaacctgggccccggcgagacgctgacgtcccccgagtgcgtcgccgtctactccgacaagggcctgggctccgtctcccgcaagttccaccgcctgtaccgcaaccacctgatgaagtccaagttcgccacgtccgaccgccccgtgctgctgaactcctgggagggcgtctacttcgactacaaccagtcctccatcgagacgctggcggaggagtccgccgccctgggcgtgcacctgttcgtcatggacgacggctggttcggcgacaagtacccccgcgtgtccgacaacgccggcctgggcgactggatgcccaaccccgcccgcttccccgacggcctgacgcccgtcgtgcaggacatcaccaacctgaccgtcaacggcaccgagtccaccaagctgcgcttcggcatctgggtggagcccgagatggtgaaccccaactccaccctgtaccacgagcaccccgagtgggcgctgcacgcgggcccctacccccgcaccgagcgccgcaaccagctggtcctgaacctggccctgcccgcggtccaggacttcatcatcgacttcatgaccaacctgctgcaggacaccggcatctcctacgtcaagtgggacaacaaccgcggcatccacgagacgccctccccctccacggaccaccagtacatgctgggcctgtaccgcgtgttcgacacgctgaccacgcgcttccccgacgtcctgtgggagggctgcgcgtccggcggcggccggttcgacgccggcatgctgcagtacgtcccccagatctggacgtccgacaacacggacgcgatcgaccgcatcaccatccagttcggcacctccctggcctaccccccctccgccatgggcgcccacctgtccgcggtgcccaacgcccagaccggccgcacggtgcccttcaccttccgcgcccacgtcgcgatgatgggcggctccttcggcctggagctggaccccgccaccgtggagggcgacgagatcgtgcccgagctgctggcgctggccgagaaggtgaaccccatcatcctgaacggcgacctgtaccgcctgcgcctgccccaggactcccagtggcccgcggccctgttcgtgtcccaggacggcgcccaggccgtcctgttctacttccaggtgcagcccaacgtcaaccacgccgtcccctgggtccgcctgcagggcctggaccccaaggccgactacacggtggacggcgaccagacgtactccggcgcgaccctgatgaacctgggcctgcagtactccttcgacaccgagtacggctccaaggtggtgttcctggagcgccagtaa

SEQ ID NO: 119 - DNA, 4011 bp, Aspergillus niger
gcggccgcgtggacgagggctacaaccccgcctacggcgcgcgcccgctgcgccgcgccatcatgcgcctgctggaggacgcgctggccgagcgcatgctcgccggcgacgtcaaggagggcgactcggtcatcatggacgtcgatggcgatggcgccatcagcgtcctcaacggagaccgcacccacaccaccaccatcgactcctccccggcgggcatctcgtagacgcgagagggagggagggaggattttcagagggagatgagacgaggactgggccgggggccttggggcgctgctggagcgtggtgagagcgcggcggacgtgccttttcttcttccgtgcgcgcgctcttggccattgatccccgattcgcgcccgcatccccccactgcccccatcatcttgcctgttgtcgtggcactgacataaaccccctgcgctgcgctgctccgctactattgatataggtctcacgcgccaatcttttttgctccgggtaaccgtctggacgccagaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatgatcggctcctcccacgcggtcgtcgccctgggcctgttcaccctgtacggccactccgccgccgcgcccgccatcggcgcctccaactcccagaccatcgtcacgaacggcacctccttcgccctgaacggcgacaacgtgtcctaccgcttccacgtgaactcctccacgggcgacctgatctccgaccacttcggcggcgtggtgtccggcaccatcccctcccccgtggagcccgcggtcaacggctgggtgggcatgcccggccgcatccgccgcgagttccccgaccagggccgcggcgacttccgcatccccgcggtgcgcatccgcgagtccgccggctacaccgtctccgacctgcagtacgtgtcccacgaggtgatcgagggcaagtacgcgctgcccggcctgcccgccacgttcggcgacgcccaggacgccaccaccctggtggtgcacctgtacgacaactactcctccgtcgcggccgacctgtcctactccatcttccccaagtacgacgcgatcgtccgctccgtgaacgtgaccaaccagggccccggcaacatcaccatcgaggcgctggcctccatctccatcgacttcccctacgaggacctggacatggtgtccctgcgcggcgactgggcccgcgaggcgaacgtgcagcgctccaaggtccagtacggcgtgcagggcttcggctcctccaccggctactcctcccacctgcacaaccccttcctggcgatcgtcgaccccgcgaccaccgagtcccagggcgaggcctggggcttcaacctggtctacaccggctccttctccgcccaggtcgagaagggctcccagggcttcacgcgcgccctgctgggcttcaaccccgaccagctgtcctggaacctgggccccggcgagacgctgacgtcccccgagtgcgtcgccgtctactccgacaagggcctgggctccgtctcccgcaagttccaccgcctgtaccgcaaccacctgatgaagtccaagttcgccacgtccgaccgccccgtgctgctgaactcctgggagggcgtctacttcgactacaaccagtcctccatcgagacgctggcggaggagtccgccgccctgggcgtgcacctgttcgtcatggacgacggctggttcggcgacaagtacccccgcgtgtccgacaacgccggcctgggcgactggatgcccaaccccgcccgcttccccgacggcctgacgcccgtcgtgcaggacatcaccaacctgaccgtcaacggcaccgagtccaccaagctgcgcttcggcatctgggtggagcccgagatggtgaaccccaactccaccctgtaccacgagcaccccgagtgggcgctgcacgcgggcccctacccccgcaccgagcgccgcaaccagctggtcctgaacctggccctgcccgcggtccaggacttcatcatcgacttcatgaccaacctgctgcaggacaccggcatctcctacgtcaagtgggacaacaaccgcggcatccacgagacgccctccccctccacggaccaccagtacatgctgggcctgtaccgcgtgttcgacacgctgaccacgcgcttccccgacgtcctgtgggagggctgcgcgtccggcggcggccggttcgacgccggcatgctgcagtacgtcccccagatctggacgtccgacaacacggacgcgatcgaccgcatcaccatccagttcggcacctccctggcctaccccccctccgccatgggcgcccacctgtccgcggtgcccaacgcccagaccggccgcacggtgcccttcaccttccgcgcccacgtcgcgatgatgggcggctccttcggcctggagctggaccccgccaccgtggagggcgacgagatcgtgcccgagctgctggcgctggccgagaaggtgaaccccatcatcctgaacggcgacctgtaccgcctgcgcctgccccaggactcccagtggcccgcggccctgttcgtgtcccaggacggcgcccaggccgtcctgttctacttccaggtgcagcccaacgtcaaccacgccgtcccctgggtccgcctgcagggcctggaccccaaggccgactacacggtggacggcgaccagacgtactccggcgcgaccctgatgaacctgggcctgcagtactccttcgacaccgagtacggctccaaggtggtgttcctggagcgccagtaacaattgaagcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcagaatagtatcgggtgatgcgaagtcagaaccaggcagggcctgtcgcctgaggtggcaacgatgggaagcaatcaatctgggtacagtcgtccgcacgatcccgtgatctcccccaccgacacctatccccgcccatcccggcccaccctttcagtcccctcagcatgcattgtgcaccgcgacaaagcatgtctgctcgtgcactggttcaggccacggcgcaccgagtcctcgcccttcgcagagtgatcaccctccccggaaccagccacgctcgctgctgcgggccgatcagccgcgcgcactccctgcaactagggacaactcaggcaaccacgcgcctcacaagcatggccgccgtggcatccaacccgctcgtgacggtgggtgcgcaagtgccaggggcctcgtcgtcacggcgtgcatcctcgagggatgcgatccggcaactatatgtcgtttatctccccaccaatcacaggatgagcccctgtctaga

SEQ ID NO: 120 - protein, 411 aa, Cyamopsis tetragonoloba
MATHYSIIGGMIIVVLLMIIGSEGGRLLEKKNRTSAEAEHYNVRRYLAENGLGQTPPMGWNSWNHFGCDINENVVRETADAMVSTGLAALGYQYINLDDCWAELNRDSEGNMVPNAAAFPSGIKALADYVHSKGLKLGVYSDAGNQTCSKRMPGSLGHEEQDAKTFASWGVDYLKYDNCENLGISVKERYPPMGKALLSSGRPIFFSMCEWGWEDPQIWAKSIGNSWRTTGDIEDNWNSMTSIADSNDKWASYAGPGGWNDPDMLEVGNGGMTTEEYRSHFSIWALAKAPLLVGCDIRAMDDTTHELISNAEVIAVNQDKLGVQGKKVKSTNDLEVWAGPLSDNKVAVILWNRSSSRATVTASWSDIGLQQGTTVDARDLWEHSTQSLVSGEISAEIDSHACKMYVLTPRS

SEQ ID NO: 121 - DNA, 1236 bp, Cyamopsis tetragonoloba
atggccacccactactccatcatcggcggcatgatcatcgtcgtcctgctgatgatcatcggctccgagggcggccggctgctggagaagaagaaccgcacctccgccgaggcggagcactacaacgtgcgccgctacctggccgagaacggcctgggccagaccccccccatgggctggaactcctggaaccacttcggctgcgacatcaacgagaacgtcgtccgcgagacggcggacgccatggtgtccaccggcctggccgccctgggctaccagtacatcaacctggacgactgctgggcggagctgaaccgcgactccgagggcaacatggtgcccaacgccgccgcgttcccctccggcatcaaggcgctggcggactacgtccactccaagggcctgaagctgggcgtctactccgacgcgggcaaccagacctgctccaagcgcatgcccggctccctgggccacgaggagcaggacgcgaagacgttcgcctcctggggcgtcgactacctgaagtacgacaactgcgagaacctgggcatctccgtgaaggagcgctacccccccatgggcaaggcgctgctgtcctccggccgccccatcttcttctccatgtgcgagtggggctgggaggacccccagatctgggccaagtccatcggcaactcctggcgcaccaccggcgacatcgaggacaactggaactccatgacctccatcgccgactccaacgacaagtgggcctcctacgccggccccggcggctggaacgaccccgacatgctggaggtcggcaacggcggcatgacgacggaggagtaccgctcccacttctccatctgggccctggccaaggcgcccctgctggtgggctgcgacatccgcgcgatggacgacacgacgcacgagctgatctccaacgccgaggtgatcgcggtgaaccaggacaagctgggcgtgcagggcaagaaggtcaagtccacgaacgacctggaggtctgggccggccccctgtccgacaacaaggtggcggtgatcctgtggaaccgctcctcctcccgcgccaccgtcaccgcgtcctggtccgacatcggcctgcagcagggcaccaccgtcgacgcgcgcgacctgtgggagcactccacgcagtccctggtgtccggcgagatctccgccgagatcgactcccacgcctgcaagatgtacgtcctgacgccccgctcctaa

SEQ ID NO: 122 - DNA, 3003 bp, Cyamopsis tetragonoloba
gcggccgcgtggacgagggctacaaccccgcctacggcgcgcgcccgctgcgccgcgccatcatgcgcctgctggaggacgcgctggccgagcgcatgctcgccggcgacgtcaaggagggcgactcggtcatcatggacgtcgatggcgatggcgccatcagcgtcctcaacggagaccgcacccacaccaccaccatcgactcctccccggcgggcatctcgtagacgcgagagggagggagggaggattttcagagggagatgagacgaggactgggccgggggccttggggcgctgctggagcgtggtgagagcgcggcggacgtgccttttcttcttccgtgcgcgcgctcttggccattgatccccgattcgcgcccgcatccccccactgcccccatcatcttgcctgttgtcgtggcactgacataaaccccctgcgctgcgctgctccgctactattgatataggtctcacgcgccaatcttttttgctccgggtaaccgtctggacgccagaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccacccactactccatcatcggcggcatgatcatcgtcgtcctgctgatgatcatcggctccgagggcggccggctgctggagaagaagaaccgcacctccgccgaggcggagcactacaacgtgcgccgctacctggccgagaacggcctgggccagaccccccccatgggctggaactcctggaaccacttcggctgcgacatcaacgagaacgtcgtccgcgagacggcggacgccatggtgtccaccggcctggccgccctgggctaccagtacatcaacctggacgactgctgggcggagctgaaccgcgactccgagggcaacatggtgcccaacgccgccgcgttcccctccggcatcaaggcgctggcggactacgtccactccaagggcctgaagctgggcgtctactccgacgcgggcaaccagacctgctccaagcgcatgcccggctccctgggccacgaggagcaggacgcgaagacgttcgcctcctggggcgtcgactacctgaagtacgacaactgcgagaacctgggcatctccgtgaaggagcgctacccccccatgggcaaggcgctgctgtcctccggccgccccatcttcttctccatgtgcgagtggggctgggaggacccccagatctgggccaagtccatcggcaactcctggcgcaccaccggcgacatcgaggacaactggaactccatgacctccatcgccgactccaacgacaagtgggcctcctacgccggccccggcggctggaacgaccccgacatgctggaggtcggcaacggcggcatgacgacggaggagtaccgctcccacttctccatctgggccctggccaaggcgcccctgctggtgggctgcgacatccgcgcgatggacgacacgacgcacgagctgatctccaacgccgaggtgatcgcggtgaaccaggacaagctgggcgtgcagggcaagaaggtcaagtccacgaacgacctggaggtctgggccggccccctgtccgacaacaaggtggcggtgatcctgtggaaccgctcctcctcccgcgccaccgtcaccgcgtcctggtccgacatcggcctgcagcagggcaccaccgtcgacgcgcgcgacctgtgggagcactccacgcagtccctggtgtccggcgagatctccgccgagatcgactcccacgcctgcaagatgtacgtcctgacgccccgctcctaacaattgaagcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcagaatagtatcgggtgatgcgaagtcagaaccaggcagggcctgtcgcctgaggtggcaacgatgggaagcaatcaatctgggtacagtcgtccgcacgatcccgtgatctcccccaccgacacctatccccgcccatcccggcccaccctttcagtcccctcagcatgcattgtgcaccgcgacaaagcatgtctgctcgtgcactggttcaggccacggcgcaccgagtcctcgcccttcgcagagtgatcaccctccccggaaccagccacgctcgctgctgcgggccgatcagccgcgcgcactccctgcaactagggacaactcaggcaaccacgcgcctcacaagcatggccgccgtggcatccaacccgctcgtgacggtgggtgcgcaagtgccaggggcctcgtcgtcacggcgtgcatcctcgagggatgcgatccggcaactatatgtcgtttatctccccaccaatcacaggatgagcccctgtctaga

SEQ ID NO: 123 - DNA, 22 bp, Chlorella vulgaris
actgcaatgctgatgcacggga

SEQ ID NO: 124 - DNA, 19 bp, Chlorella vulgaris
tccaggtccttttcgcact

SEQ ID NO: 125 - protein, 632 aa, Unknown
  Coccomyxa species
MTTNLAKLPLGGLSSRSSIAGAPLRVNSHSRERHLGAKTTAIAAPERLDYLDNAEEARLQQTDAFAELKALSSRQSVNRPQKGELSFRQSPTFQDCFPGSEKCYREVEHDGKTLKVPFRRVHLQDDNGHFDLYDTSGPQGVNPREGLPKIRSSWVEPREARGDKVQTQQYYAKQGIITEEMAFCAARERMDPEFIRSEVARGRAIIPANKRHLELEPTVVGRNFLVKVNANIGNSAVSSSIEEEVEKLQWSTIWGADTAMDLSTGNNIHETREWVMRNSPVPVGTVPIYQCLEKAGGIVENITWELFRETLIEQAEQGVDYFTIHAGVLLRYIPLTANRVTGIVSRGGSIHAKLCLLDHTENFAYMHWDEILDICAQYDITLSIGDGLRPGCIADANDAAQFAELKTQGELTRRAWAKDVQVMNEGPGHVPLHKIPENMEKQLDWCSEAPFYTLGPLATDIAPAYDHITSAIGAATIGALGTALLCYVTPKEHLGLPDRDDVKAGVIAYKIAAHAADLAKGHPYAQEWDNALSKARFEFRWYDQFHLSLDPVTARLFHDATLPQEPAKTAHFCSMCGPKFCSMQITQDLREYAKNHQMEEDEAIQTGMAEMSEQFKSIGAEVYLDEAVLEHA

SEQ ID NO: 126 - protein, 40 aa, Unknown
  Coccomyxa species
MTTNLAKLPLGGLSSRSSIAGAPLRVNSHSRERHLGAKTT

SEQ ID NO: 127 - DNA, 6649 bp, Unknown
  Coccomyxa species
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatgaccaccaacctggctaagctgcctctcggcggcctctcttctcggtcgtccatcgccggggctcctctgcgcgtgaacagccacagccgcgagcgccacctgggcgccaagaccaccgcgatcgccgctcccgagcggctggactacctcgacaacgcggaggaggcgcggctgcagcagacggacgccttcgccgagctgaaggcgctgtcgagccgccagtccgtgaaccggccccaaaagggcgagctgtcgttccggcagtcgccgacctttcaggactgcttccctggctcggagaagtgctaccgcgaggtggagcacgatggcaagacgctcaaggtgccttttcgccgggtgcacctgcaggacgacaacggccatttcgacctgtacgacacctctggcccccagggcgtgaacccccgcgagggtctgcccaagatccgctcctcctgggtggagccgcgcgaggcgcggggcgacaaggtgcaaacgcagcagtactacgccaagcaaggcatcatcaccgaggagatggccttctgcgctgcgcgcgagcgcatggaccccgagttcatccggtctgaggtggcccggggtcgggccatcatccctgcgaacaagcgccatctggagctggagccgaccgtcgtgggccgcaactttctggtcaaggtgaacgccaacatcggcaactctgcggtcagctcgagcatcgaggaggaggtggagaagctgcagtggagcaccatctggggtgccgacacggccatggacctgagcaccggcaacaacatccacgagacgcgcgagtgggtgatgcgcaacagcccggtccctgtgggtacggtccctatctaccagtgcctggagaaggcgggcggcatcgtggagaacatcacctgggagctgttccgggagacgctgatcgagcaggccgagcagggcgtcgactactttaccatccacgcgggggtcctgctccgctacatccccctgacggcgaaccgcgtcaccggcatcgtcagccgcggcggctctatccatgccaagctctgcctgctggaccacaccgagaacttcgcctacatgcactgggacgagatcctggacatctgcgcccagtacgacatcaccctgtcgatcggcgacggcctgcgccccggctgcatcgcggacgccaacgacgctgcccagtttgctgagctgaagacccagggcgagctgacccgccgcgcctgggcgaaggacgtgcaggtgatgaacgagggtcccggccatgtgccgctgcacaagatccccgagaacatggagaagcagctggactggtgcagcgaggcgcccttctacacgctcggccccctggcgacggacatcgcgcctgcgtacgaccacatcacctccgcgatcggcgccgccacgatcggcgcgctggggaccgcgctgctgtgttacgtgaccccgaaggagcacctgggcctccccgatcgcgacgacgtgaaggccggggtgatcgcctacaagatcgcggcgcacgcggctgacctggcgaagggtcacccctacgctcaggagtgggataacgccctctctaaggcgcgcttcgagttccggtggtacgaccagttccacctgtcgctggaccccgtcaccgcccgcctgttccatgacgcgaccctgccgcaggagcccgccaagaccgcccacttctgctccatgtgcggccccaagttctgctccatgcagatcacccaggacctccgcgagtacgccaagaaccatcaaatggaggaggacgaggcgatccaaaccggcatggccgagatgtccgagcagttcaagagcatcggcgcggaggtctacctcgacgaggcggtgctggagcacgcgtaagcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagctgaagagc

SEQ ID NO: 128 - DNA, 1899 bp, Unknown
  Coccomyxa species
atgaccaccaacctggctaagctgcctctcggcggcctctcttctcggtcgtccatcgccggggctcctctgcgcgtgaacagccacagccgcgagcgccacctgggcgccaagaccaccgcgatcgccgctcccgagcggctggactacctcgacaacgcggaggaggcgcggctgcagcagacggacgccttcgccgagctgaaggcgctgtcgagccgccagtccgtgaaccggccccaaaagggcgagctgtcgttccggcagtcgccgacctttcaggactgcttccctggctcggagaagtgctaccgcgaggtggagcacgatggcaagacgctcaaggtgccttttcgccgggtgcacctgcaggacgacaacggccatttcgacctgtacgacacctctggcccccagggcgtgaacccccgcgagggtctgcccaagatccgctcctcctgggtggagccgcgcgaggcgcggggcgacaaggtgcaaacgcagcagtactacgccaagcaaggcatcatcaccgaggagatggccttctgcgctgcgcgcgagcgcatggaccccgagttcatccggtctgaggtggcccggggtcgggccatcatccctgcgaacaagcgccatctggagctggagccgaccgtcgtgggccgcaactttctggtcaaggtgaacgccaacatcggcaactctgcggtcagctcgagcatcgaggaggaggtggagaagctgcagtggagcaccatctggggtgccgacacggccatggacctgagcaccggcaacaacatccacgagacgcgcgagtgggtgatgcgcaacagcccggtccctgtgggtacggtccctatctaccagtgcctggagaaggcgggcggcatcgtggagaacatcacctgggagctgttccgggagacgctgatcgagcaggccgagcagggcgtcgactactttaccatccacgcgggggtcctgctccgctacatccccctgacggcgaaccgcgtcaccggcatcgtcagccgcggcggctctatccatgccaagctctgcctgctggaccacaccgagaacttcgcctacatgcactgggacgagatcctggacatctgcgcccagtacgacatcaccctgtcgatcggcgacggcctgcgccccggctgcatcgcggacgccaacgacgctgcccagtttgctgagctgaagacccagggcgagctgacccgccgcgcctgggcgaaggacgtgcaggtgatgaacgagggtcccggccatgtgccgctgcacaagatccccgagaacatggagaagcagctggactggtgcagcgaggcgcccttctacacgctcggccccctggcgacggacatcgcgcctgcgtacgaccacatcacctccgcgatcggcgccgccacgatcggcgcgctggggaccgcgctgctgtgttacgtgaccccgaaggagcacctgggcctccccgatcgcgacgacgtgaaggccggggtgatcgcctacaagatcgcggcgcacgcggctgacctggcgaagggtcacccctacgctcaggagtgggataacgccctctctaaggcgcgcttcgagttccggtggtacgaccagttccacctgtcgctggaccccgtcaccgcccgcctgttccatgacgcgaccctgccgcaggagcccgccaagaccgcccacttctgctccatgtgcggccccaagttctgctccatgcagatcacccaggacctccgcgagtacgccaagaaccatcaaatggaggaggacgaggcgatccaaaccggcatggccgagatgtccgagcagttcaagagcatcggcgcggaggtctacctcgacgaggcggtgctggagcacgcgtaa

SEQ ID NO: 129 - DNA, 1613 bp, Saccharomyces cerevisiae
ggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattg

SEQ ID NO: 130 - DNA, 3660 bp, Artificial Sequence
  synthetic nucleotide
gcggccgcgtggacgagggctacaaccccgcctacggcgcgcgcccgctgcgccgcgccatcatgcgcctgctggaggacgcgctggccgagcgcatgctcgccggcgacgtcaaggagggcgactcggtcatcatggacgtcgatggcgatggcgccatcagcgtcctcaacggagaccgcacccacaccaccaccatcgactcctccccggcgggcatctcgtagacgcgagagggagggagggaggattttcagagggagatgagacgaggactgggccgggggccttggggcgctgctggagcgtggtgagagcgcggcggacgtgccttttcttcttccgtgcgcgcgctcttggccattgatccccgattcgcgcccgcatccccccactgcccccatcatcttgcctgttgtcgtggcactgacataaaccccctgcgctgcgctgctccgctactattgatataggtctcacgcgccaatcttttttgctccgggtaaccgtctggacgccagaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgccgcgatcgccgctcccgagcggctggactacctcgacaacgcggaggaggcgcggctgcagcagacggacgccttcgccgagctgaaggcgctgtcgagccgccagtccgtgaaccggccccaaaagggcgagctgtcgttccggcagtcgccgacctttcaggactgcttccctggctcggagaagtgctaccgcgaggtggagcacgatggcaagacgctcaaggtgccttttcgccgggtgcacctgcaggacgacaacggccatttcgacctgtacgacacctctggcccccagggcgtgaacccccgcgagggtctgcccaagatccgctcctcctgggtggagccgcgcgaggcgcggggcgacaaggtgcaaacgcagcagtactacgccaagcaaggcatcatcaccgaggagatggccttctgcgctgcgcgcgagcgcatggaccccgagttcatccggtctgaggtggcccggggtcgggccatcatccctgcgaacaagcgccatctggagctggagccgaccgtcgtgggccgcaactttctggtcaaggtgaacgccaacatcggcaactctgcggtcagctcgagcatcgaggaggaggtggagaagctgcagtggagcaccatctggggtgccgacacggccatggacctgagcaccggcaacaacatccacgagacgcgcgagtgggtgatgcgcaacagcccggtccctgtgggtacggtccctatctaccagtgcctggagaaggcgggcggcatcgtggagaacatcacctgggagctgttccgggagacgctgatcgagcaggccgagcagggcgtcgactactttaccatccacgcgggggtcctgctccgctacatccccctgacggcgaaccgcgtcaccggcatcgtcagccgcggcggctctatccatgccaagctctgcctgctggaccacaccgagaacttcgcctacatgcactgggacgagatcctggacatctgcgcccagtacgacatcaccctgtcgatcggcgacggcctgcgccccggctgcatcgcggacgccaacgacgctgcccagtttgctgagctgaagacccagggcgagctgacccgccgcgcctgggcgaaggacgtgcaggtgatgaacgagggtcccggccatgtgccgctgcacaagatccccgagaacatggagaagcagctggactggtgcagcgaggcgcccttctacacgctcggccccctggcgacggacatcgcgcctgcgtacgaccacatcacctccgcgatcggcgccgccacgatcggcgcgctggggaccgcgctgctgtgttacgtgaccccgaaggagcacctgggcctccccgatcgcgacgacgtgaaggccggggtgatcgcctacaagatcgcggcgcacgcggctgacctggcgaagggtcacccctacgctcaggagtgggataacgccctctctaaggcgcgcttcgagttccggtggtacgaccagttccacctgtcgctggaccccgtcaccgcccgcctgttccatgacgcgaccctgccgcaggagcccgccaagaccgcccacttctgctccatgtgcggccccaagttctgctccatgcagatcacccaggacctccgcgagtacgccaagaaccatcaaatggaggaggacgaggcgatccaaaccggcatggccgagatgtccgagcagttcaagagcatcggcgcggaggtctacctcgacgaggcggtgctggagcacgcgtaacaattgaagcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcagaatagtatcgggtgatgcgaagtcagaaccaggcagggcctgtcgcctgaggtggcaacgatgggaagcaatcaatctgggtacagtcgtccgcacgatcccgtgatctcccccaccgacacctatccccgcccatcccggcccaccctttcagtcccctcagcatgcattgtgcaccgcgacaaagcatgtctgctcgtgcactggttcaggccacggcgcaccgagtcctcgcccttcgcagagtgatcaccctccccggaaccagccacgctcgctgctgcgggccgatcagccgcgcgcactccctgcaactagggacaactcaggcaaccacgcgcctcacaagcatggccgccgtggcatccaacccgctcgtgacggtgggtgcgcaagtgccaggggcctcgtcgtcacggcgtgcatcctcgagggatgcgatccggcaactatatgtcgtttatctccccaccaatcacaggatgagcccctgtctaga

SEQ ID NO: 131 - DNA, 1905 bp, Artificial Sequence
  synthetic nucleotide
actagtatggccaccgcatccactttctcggcgttcaatgcccgctgcggcgacctgcgtcgctcggcgggctccgggccccggcgcccagcgaggcccctccccgtgcgcgggcgcgccgcgatcgccgctcccgagcggctggactacctcgacaacgcggaggaggcgcggctgcagcagacggacgccttcgccgagctgaaggcgctgtcgagccgccagtccgtgaaccggccccaaaagggcgagctgtcgttccggcagtcgccgacctttcaggactgcttccctggctcggagaagtgctaccgcgaggtggagcacgatggcaagacgctcaaggtgccttttcgccgggtgcacctgcaggacgacaacggccatttcgacctgtacgacacctctggcccccagggcgtgaacccccgcgagggtctgcccaagatccgctcctcctgggtggagccgcgcgaggcgcggggcgacaaggtgcaaacgcagcagtactacgccaagcaaggcatcatcaccgaggagatggccttctgcgctgcgcgcgagcgcatggaccccgagttcatccggtctgaggtggcccggggtcgggccatcatccctgcgaacaagcgccatctggagctggagccgaccgtcgtgggccgcaactttctggtcaaggtgaacgccaacatcggcaactctgcggtcagctcgagcatcgaggaggaggtggagaagctgcagtggagcaccatctggggtgccgacacggccatggacctgagcaccggcaacaacatccacgagacgcgcgagtgggtgatgcgcaacagcccggtccctgtgggtacggtccctatctaccagtgcctggagaaggcgggcggcatcgtggagaacatcacctgggagctgttccgggagacgctgatcgagcaggccgagcagggcgtcgactactttaccatccacgcgggggtcctgctccgctacatccccctgacggcgaaccgcgtcaccggcatcgtcagccgcggcggctctatccatgccaagctctgcctgctggaccacaccgagaacttcgcctacatgcactgggacgagatcctggacatctgcgcccagtacgacatcaccctgtcgatcggcgacggcctgcgccccggctgcatcgcggacgccaacgacgctgcccagtttgctgagctgaagacccagggcgagctgacccgccgcgcctgggcgaaggacgtgcaggtgatgaacgagggtcccggccatgtgccgctgcacaagatccccgagaacatggagaagcagctggactggtgcagcgaggcgcccttctacacgctcggccccctggcgacggacatcgcgcctgcgtacgaccacatcacctccgcgatcggcgccgccacgatcggcgcgctggggaccgcgctgctgtgttacgtgaccccgaaggagcacctgggcctccccgatcgcgacgacgtgaaggccggggtgatcgcctacaagatcgcggcgcacgcggctgacctggcgaagggtcacccctacgctcaggagtgggataacgccctctctaaggcgcgcttcgagttccggtggtacgaccagttccacctgtcgctggaccccgtcaccgcccgcctgttccatgacgcgaccctgccgcaggagcccgccaagaccgcccacttctgctccatgtgcggccccaagttctgctccatgcagatcacccaggacctccgcgagtacgccaagaaccatcaaatggaggaggacgaggcgatccaaaccggcatggccgagatgtccgagcagttcaagagcatcggcgcggaggtctacctcgacgaggcggtgctggagcacgcgtaacaattg

SEQ ID NO: 132 - DNA, 1182 bp, Chlorella protothecoides
actagagagtttaggtccagcgtccgtggggggggacgggctgggagcttgggccgggaagggcaagacgatgcagtccctctggggagtcacagccgactgtgtgtgttgcactgtgcggcccgcagcactcacacgcaaaatgcctggccgacaggcaggccctgtccagtgcaacatccacggtccctctcatcaggctcaccttgctcattgacataacggaatgcgtaccgctctttcagatctgtccatccagagaggggagcaggctccccaccgacgctgtcaaacttgcttcctgcccaaccgaaaacattattgtttgagggggggggggggggggcagattgcatggcgggatatctcgtgaggaacatcactgggacactgtggaacacagtgagtgcagtatgcagagcatgtatgctaggggtcagcgcaggaagggggcctttcccagtctcccatgccactgcaccgtatccacgactcaccaggaccagcttcttgatcggcttccgctcccgtggacaccagtgtgtagcctctggactccaggtatgcgtgcaccgcaaaggccagccgatcgtgccgattcctggggtggaggatatgagtcagccaacttggggctcagagtgcacactggggcacgatacgaaacaacatctacaccgtgtcctccatgctgacacaccacagcttcgctccacctgaatgtgggcgcatgggcccgaatcacagccaatgtcgctgctgccataatgtgatccagaccctctccgcccagatgccgagcggatcgtgggcgctgaatagattcctgtttcgatcactgtttgggtcctttccttttcgtctcggatgcgcgtctcgaaacaggctgcgtcgggctttcggatcccttttgctccctccgtcaccatcctgcgcgcgggcaagttgcttgaccctgggctggtaccagggttggagggtattaccgcgtcaggccattcccagcccggattcaattcaaagtctgggccaccaccctccgccgctctgtctgatcactccacattcgtgcatacactacgttcaagtcctgatccaggcgtgtctcgggacaaggtgtgcttgagtttgaatctcaaggacccactccagcacagctgctggttgaccccgccctcgcaa

SEQ ID NO: 133 - DNA, 161 bp, Chlorella protothecoides
acggagcgtcgtgcgggagggagtgtgccgagcggggagtcccggtctgtgcgaggcccggcagctgacgctggcgagccgtacgccccgagggtccccctcccctgcaccctcttccccttccctctgacggccgcgcctgttcttgcatgttcagcgac

SEQ ID NO: 134 - DNA, 6306 bp, Arabidopsis thaliana
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatccactagagagtttaggtccagcgtccgtggggggggacgggctgggagcttgggccgggaagggcaagacgatgcagtccctctggggagtcacagccgactgtgtgtgttgcactgtgcggcccgcagcactcacacgcaaaatgcctggccgacaggcaggccctgtccagtgcaacatccacggtccctctcatcaggctcaccttgctcattgacataacggaatgcgtaccgctctttcagatctgtccatccagagaggggagcaggctccccaccgacgctgtcaaacttgcttcctgcccaaccgaaaacattattgtttgagggggggggggggggggcagattgcatggcgggatatctcgtgaggaacatcactgggacactgtggaacacagtgagtgcagtatgcagagcatgtatgctaggggtcagcgcaggaagggggcctttcccagtctcccatgccactgcaccgtatccacgactcaccaggaccagcttcttgatcggcttccgctcccgtggacaccagtgtgtagcctctggactccaggtatgcgtgcaccgcaaaggccagccgatcgtgccgattcctggggtggaggatatgagtcagccaacttggggctcagagtgcacactggggcacgatacgaaacaacatctacaccgtgtcctccatgctgacacaccacagcttcgctccacctgaatgtgggcgcatgggcccgaatcacagccaatgtcgctgctgccataatgtgatccagaccctctccgcccagatgccgagcggatcgtgggcgctgaatagattcctgtttcgatcactgtttgggtcctttccttttcgtctcggatgcgcgtctcgaaacaggctgcgtcgggctttcggatcccttttgctccctccgtcaccatcctgcgcgcgggcaagttgcttgaccctgggctggtaccagggttggagggtattaccgcgtcaggccattcccagcccggattcaattcaaagtctgggccaccaccctccgccgctctgtctgatcactccacattcgtgcatacactacgttcaagtcctgatccaggcgtgtctcgggacaaggtgtgcttgagtttgaatctcaaggacccactccagcacagctgctggttgaccccgccctcgcaaactagtatggccaccgcatccactttctcggcgttcaatgcccgctgcggcgacctgcgtcgctcggcgggctccgggccccggcgcccagcgaggcccctccccgtgcgcgggcgcgccgtccaggccgcggccacccgcttcaagaaggagacgacgaccacccgcgccacgctgacgttcgacccccccacgaccaactccgagcgcgccaagcagcgcaagcacaccatcgacccctcctcccccgacttccagcccatcccctccttcgaggagtgcttccccaagtccacgaaggagcacaaggaggtggtgcacgaggagtccggccacgtcctgaaggtgcccttccgccgcgtgcacctgtccggcggcgagcccgccttcgacaactacgacacgtccggcccccagaacgtcaacgcccacatcggcctggcgaagctgcgcaaggagtggatcgaccgccgcgagaagctgggcacgccccgctacacgcagatgtactacgcgaagcagggcatcatcacggaggagatgctgtactgcgcgacgcgcgagaagctggaccccgagttcgtccgctccgaggtcgcgcggggccgcgccatcatcccctccaacaagaagcacctggagctggagcccatgatcgtgggccgcaagttcctggtgaaggtgaacgcgaacatcggcaactccgccgtggcctcctccatcgaggaggaggtctacaaggtgcagtgggccaccatgtggggcgccgacaccatcatggacctgtccacgggccgccacatccacgagacgcgcgagtggatcctgcgcaactccgcggtccccgtgggcaccgtccccatctaccaggcgctggagaaggtggacggcatcgcggagaacctgaactgggaggtgttccgcgagacgctgatcgagcaggccgagcagggcgtggactacttcacgatccacgcgggcgtgctgctgcgctacatccccctgaccgccaagcgcctgacgggcatcgtgtcccgcggcggctccatccacgcgaagtggtgcctggcctaccacaaggagaacttcgcctacgagcactgggacgacatcctggacatctgcaaccagtacgacgtcgccctgtccatcggcgacggcctgcgccccggctccatctacgacgccaacgacacggcccagttcgccgagctgctgacccagggcgagctgacgcgccgcgcgtgggagaaggacgtgcaggtgatgaacgagggccccggccacgtgcccatgcacaagatccccgagaacatgcagaagcagctggagtggtgcaacgaggcgcccttctacaccctgggccccctgacgaccgacatcgcgcccggctacgaccacatcacctccgccatcggcgcggccaacatcggcgccctgggcaccgccctgctgtgctacgtgacgcccaaggagcacctgggcctgcccaaccgcgacgacgtgaaggcgggcgtcatcgcctacaagatcgccgcccacgcggccgacctggccaagcagcacccccacgcccaggcgtgggacgacgcgctgtccaaggcgcgcttcgagttccgctggatggaccagttcgcgctgtccctggaccccatgacggcgatgtccttccacgacgagacgctgcccgcggacggcgcgaaggtcgcccacttctgctccatgtgcggccccaagttctgctccatgaagatcacggaggacatccgcaagtacgccgaggagaacggctacggctccgccgaggaggccatccgccagggcatggacgccatgtccgaggagttcaacatcgccaagaagacgatctccggcgagcagcacggcgaggtcggcggcgagatctacctgcccgagtcctacgtcaaggccgcgcagaagtgatacgtactcgagacggagcgtcgtgcgggagggagtgtgccgagcggggagtcccggtctgtgcgaggcccggcagctgacgctggcgagccgtacgccccgagggtccccctcccctgcaccctcttccccttccctctgacggccgcgcctgttcttgcatgttcagcgacgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 135 - DNA, 1938 bp, Artificial Sequence
  synthesized nucleotide
atggccaccgcatccactttctcggcgttcaatgcccgctgcggcgacctgcgtcgctcggcgggctccgggccccggcgcccagcgaggcccctccccgtgcgcgggcgcgccgtccaggccgcggccacccgcttcaagaaggagacgacgaccacccgcgccacgctgacgttcgacccccccacgaccaactccgagcgcgccaagcagcgcaagcacaccatcgacccctcctcccccgacttccagcccatcccctccttcgaggagtgcttccccaagtccacgaaggagcacaaggaggtggtgcacgaggagtccggccacgtcctgaaggtgcccttccgccgcgtgcacctgtccggcggcgagcccgccttcgacaactacgacacgtccggcccccagaacgtcaacgcccacatcggcctggcgaagctgcgcaaggagtggatcgaccgccgcgagaagctgggcacgccccgctacacgcagatgtactacgcgaagcagggcatcatcacggaggagatgctgtactgcgcgacgcgcgagaagctggaccccgagttcgtccgctccgaggtcgcgcggggccgcgccatcatcccctccaacaagaagcacctggagctggagcccatgatcgtgggccgcaagttcctggtgaaggtgaacgcgaacatcggcaactccgccgtggcctcctccatcgaggaggaggtctacaaggtgcagtgggccaccatgtggggcgccgacaccatcatggacctgtccacgggccgccacatccacgagacgcgcgagtggatcctgcgcaactccgcggtccccgtgggcaccgtccccatctaccaggcgctggagaaggtggacggcatcgcggagaacctgaactgggaggtgttccgcgagacgctgatcgagcaggccgagcagggcgtggactacttcacgatccacgcgggcgtgctgctgcgctacatccccctgaccgccaagcgcctgacgggcatcgtgtcccgcggcggctccatccacgcgaagtggtgcctggcctaccacaaggagaacttcgcctacgagcactgggacgacatcctggacatctgcaaccagtacgacgtcgccctgtccatcggcgacggcctgcgccccggctccatctacgacgccaacgacacggcccagttcgccgagctgctgacccagggcgagctgacgcgccgcgcgtgggagaaggacgtgcaggtgatgaacgagggccccggccacgtgcccatgcacaagatccccgagaacatgcagaagcagctggagtggtgcaacgaggcgcccttctacaccctgggccccctgacgaccgacatcgcgcccggctacgaccacatcacctccgccatcggcgcggccaacatcggcgccctgggcaccgccctgctgtgctacgtgacgcccaaggagcacctgggcctgcccaaccgcgacgacgtgaaggcgggcgtcatcgcctacaagatcgccgcccacgcggccgacctggccaagcagcacccccacgcccaggcgtgggacgacgcgctgtccaaggcgcgcttcgagttccgctggatggaccagttcgcgctgtccctggaccccatgacggcgatgtccttccacgacgagacgctgcccgcggacggcgcgaaggtcgcccacttctgctccatgtgcggccccaagttctgctccatgaagatcacggaggacatccgcaagtacgccgaggagaacggctacggctccgccgaggaggccatccgccagggcatggacgccatgtccgaggagttcaacatcgccaagaagacgatctccggcgagcagcacggcgaggtcggcggcgagatctacctgcccgagtcctacgtcaaggccgcgcagaagtga

SEQ ID NO: 136 - protein, 644 aa, Arabidopsis thaliana
MAASVHCTLMSVVCNNKNHSARPKLPNSSLLPGFDVVVQAAATRFKKETTTTRATLTFDPPTTNSERAKQRKHTIDPSSPDFQPIPSFEECFPKSTKEHKEVVHEESGHVLKVPFRRVHLSGGEPAFDNYDTSGPQNVNAHIGLAKLRKEWIDRREKLGTPRYTQMYYAKQGIITEEMLYCATREKLDPEFVRSEVARGRAIIPSNKKHLELEPMIVGRKFLVKVNANIGNSAVASSIEEEVYKVQWATMWGADTIMDLSTGRHIHETREWILRNSAVPVGTVPIYQALEKVDGIAENLNWEVFRETLIEQAEQGVDYFTIHAGVLLRYIPLTAKRLTGIVSRGGSIHAKWCLAYHKENFAYEHWDDILDICNQYDVALSIGDGLRPGSIYDANDTAQFAELLTQGELTRRAWEKDVQVMNEGPGHVPMHKIPENMQKQLEWCNEAPFYTLGPLTTDIAPGYDHITSAIGAANIGALGTALLCYVTPKEHLGLPNRDDVKAGVIAYKIAAHAADLAKQHPHAQAWDDALSKARFEFRWMDQFALSLDPMTAMSFHDETLPADGAKVAHFCSMCGPKFCSMKITEDIRKYAEENGYGSAEEAIRQGMDAMSEEFNIAKKTISGEQHGEVGGEIYLPESYVKAAQK

SEQ ID NO: 137 - DNA, 6130 bp, Unknown
  Synechocystis species
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatccactagagagtttaggtccagcgtccgtggggggggacgggctgggagcttgggccgggaagggcaagacgatgcagtccctctggggagtcacagccgactgtgtgtgttgcactgtgcggcccgcagcactcacacgcaaaatgcctggccgacaggcaggccctgtccagtgcaacatccacggtccctctcatcaggctcaccttgctcattgacataacggaatgcgtaccgctctttcagatctgtccatccagagaggggagcaggctccccaccgacgctgtcaaacttgcttcctgcccaaccgaaaacattattgtttgagggggggggggggggggcagattgcatggcgggatatctcgtgaggaacatcactgggacactgtggaacacagtgagtgcagtatgcagagcatgtatgctaggggtcagcgcaggaagggggcctttcccagtctcccatgccactgcaccgtatccacgactcaccaggaccagcttcttgatcggcttccgctcccgtggacaccagtgtgtagcctctggactccaggtatgcgtgcaccgcaaaggccagccgatcgtgccgattcctggggtggaggatatgagtcagccaacttggggctcagagtgcacactggggcacgatacgaaacaacatctacaccgtgtcctccatgctgacacaccacagcttcgctccacctgaatgtgggcgcatgggcccgaatcacagccaatgtcgctgctgccataatgtgatccagaccctctccgcccagatgccgagcggatcgtgggcgctgaatagattcctgtttcgatcactgtttgggtcctttccttttcgtctcggatgcgcgtctcgaaacaggctgcgtcgggctttcggatcccttttgctccctccgtcaccatcctgcgcgcgggcaagttgcttgaccctgggctggtaccagggttggagggtattaccgcgtcaggccattcccagcccggattcaattcaaagtctgggccaccaccctccgccgctctgtctgatcactccacattcgtgcatacactacgttcaagtcctgatccaggcgtgtctcgggacaaggtgtgcttgagtttgaatctcaaggacccactccagcacagctgctggttgaccccgccctcgcaaactagtatggccaccgcatccactttctcggcgttcaatgcccgctgcggcgacctgcgtcgctcggcgggctccgggccccggcgcccagcgaggcccctccccgtgcgcgggcgcgccatgcgcaccgcgtgggtcgccaagcgccagggccagacgaacgtctcccagatgcactacgcgcgcaagggcgtgatcaccgaggagatggactacgtggcgaagcgcgagaacctgcccgtggagctgatcaaggacgaggtggcgcggggccgcatgatcatccccgccaacatcaaccacacgaacctggagcccatggccatcggcatcgcctccaagtgcaaggtcaacgcgaacatcggcgcgtcccccaactcctccaacatcgacgaggaggtggagaagctgctgctgtccgtgaagtacggcgcggacacggtgatggacctgtccaccggcggcggcgacctggacgtgatccgcaccgccatcatcaacgcctcccccgtgcccatcggcacggtgcccatctaccaggccctggagtccgtgcacggctccatcgagaacctgacgcccgacgacttcctgcacatcatcgagaagcacgcccagcagggcgtggactacatgacgatccacgcgggcctgctgatcgagtacctgcccctggtgaagtcccgcatcacgggcatcgtgtcccgcggcggcggcatcatcgccaagtggatgctgcaccaccacaagcagaaccccctgtacacgcacttcgacgagatcatcgagatcttcaagaagtacgacgtgtccttctccctgggcgactccctgcgccccggctgcacccacgacgcctccgacgacgcccagctgtccgagctgaagacgctgggccagctgacgcgccgcgcctgggagcacgacgtccaggtcatggtggagggccccggccacgtccccatcgaccagatcgagttcaacgtcaagaagcagatggaggagtgctccgaggcccccttctacgtgctgggccccctggtcaccgacatcgcgcccggctacgaccacatcacctccgcgatcggcgccgccatcgcgggctggcacggcaccgcgatgctgtgctacgtgacgcccaaggagcacctgggcctgcccaacgcggaggacgtgcgcaacggcctgatcgcctacaagatcgccgcgcacgccgcggacatcgcccgccaccgccccggcgcgcgcgaccgcgacgacgagctgtccaaggcgcgctacaacttcgactggaaccgccagttcgagctgtccctggaccccgagcgcgcgaaggagtaccacgacgagacgctgcccgcggacatctacaagaccgcggagttctgctccatgtgcggccccaagttctgccccatgcagaccaaggtggacgccgagatgctggaggagctggaggtcttcctggccaaggacaaggagatggtgtcccagcgctgatacgtactcgagacggagcgtcgtgcgggagggagtgtgccgagcggggagtcccggtctgtgcgaggcccggcagctgacgctggcgagccgtacgccccgagggtccccctcccctgcaccctcttccccttccctctgacggccgcgcctgttcttgcatgttcagcgacgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttc

SEQ ID NO: 138 - DNA, 1494 bp, Artificial Sequence
  synthesized polynucleotide
atggccaccgcatccactttctcggcgttcaatgcccgctgcggcgacctgcgtcgctcggcgggctccgggccccggcgcccagcgaggcccctccccgtgcgcgggcgcgccatgcgcaccgcgtgggtcgccaagcgccagggccagacgaacgtctcccagatgcactacgcgcgcaagggcgtgatcaccgaggagatggactacgtggcgaagcgcgagaacctgcccgtggagctgatcaaggacgaggtggcgcggggccgcatgatcatccccgccaacatcaaccacacgaacctggagcccatggccatcggcatcgcctccaagtgcaaggtcaacgcgaacatcggcgcgtcccccaactcctccaacatcgacgaggaggtggagaagctgctgctgtccgtgaagtacggcgcggacacggtgatggacctgtccaccggcggcggcgacctggacgtgatccgcaccgccatcatcaacgcctcccccgtgcccatcggcacggtgcccatctaccaggccctggagtccgtgcacggctccatcgagaacctgacgcccgacgacttcctgcacatcatcgagaagcacgcccagcagggcgtggactacatgacgatccacgcgggcctgctgatcgagtacctgcccctggtgaagtcccgcatcacgggcatcgtgtcccgcggcggcggcatcatcgccaagtggatgctgcaccaccacaagcagaaccccctgtacacgcacttcgacgagatcatcgagatcttcaagaagtacgacgtgtccttctccctgggcgactccctgcgccccggctgcacccacgacgcctccgacgacgcccagctgtccgagctgaagacgctgggccagctgacgcgccgcgcctgggagcacgacgtccaggtcatggtggagggccccggccacgtccccatcgaccagatcgagttcaacgtcaagaagcagatggaggagtgctccgaggcccccttctacgtgctgggccccctggtcaccgacatcgcgcccggctacgaccacatcacctccgcgatcggcgccgccatcgcgggctggcacggcaccgcgatgctgtgctacgtgacgcccaaggagcacctgggcctgcccaacgcggaggacgtgcgcaacggcctgatcgcctacaagatcgccgcgcacgccgcggacatcgcccgccaccgccccggcgcgcgcgaccgcgacgacgagctgtccaaggcgcgctacaacttcgactggaaccgccagttcgagctgtccctggaccccgagcgcgcgaaggagtaccacgacgagacgctgcccgcggacatctacaagaccgcggagttctgctccatgtgcggccccaagttctgccccatgcagaccaaggtggacgccgagatgctggaggagctggaggtcttcctggccaaggacaaggagatggtgtcccagcgctga

SEQ ID NO: 139 - protein, 459 aa, Unknown
  Synechosystis species
MRTAWVAKRQGQTNVSQMHYARKGVITEEMDYVAKRENLPVELIKDEVARGRMIIPANINHTNLEPMAIGIASKCKVNANIGASPNSSNIDEEVEKLLLSVKYGADTVMDLSTGGGDLDVIRTAIINASPVPIGTVPIYQALESVHGSIENLTPDDFLHIIEKHAQQGVDYMTIHAGLLIEYLPLVKSRITGIVSRGGGIIAKWMLHHHKQNPLYTHFDEIIEIFKKYDVSFSLGDSLRPGCTHDASDDAQLSELKTLGQLTRRAWEHDVQVMVEGPGHVPIDQIEFNVKKQMEECSEAPFYVLGPLVTDIAPGYDHITSAIGAAIAGWHGTAMLCYVTPKEHLGLPNAEDVRNGLIAYKIAAHAADIARHRPGARDRDDELSKARYNFDWNRQFELSLDPERAKEYHDETLPADIYKTAEFCSMCGPKFCPMQTKVDAEMLEELEVFLAKDKEMVSQR

SEQ ID NO: 140 - DNA, 312 bp, Artificial Sequence; identical to SEQ ID NO: 114
  synthesized nucleotide

SEQ ID NO: 141 - DNA, 18 bp, Unknown
  Coccomyxa species
gggtgatcgcctacaaga

SEQ ID NO: 142 - DNA, 20 bp, Artificial Sequence
  synthesized primer
acgtcgcgacccatgcttcc

SEQ ID NO: 143 - DNA, 18 bp, Arabidopsis thaliana
gcgtcatcgcctacaaga

SEQ ID NO: 144 - DNA, 18 bp, Unknown
  Synechosystis sp.
cgatgctgtgctacgtga

SEQ ID NO: 145 - DNA, 1197 bp, Cuphea calophylla
atggcttccgcggcattcaccatgtcggcgtgccccgcgatgactggcagggcccctggggcacgtcgctccggacggccagtcgccacccgcctgagggggcgcgcccccaaggccaacggctccgccgtgtccctgaagtccggctccctggacacccaggaggacacctcctcctcctcctcccccccccgcaccttcatcaaccagctgcccgactggtccatgctgctgtccgccatcaccaccgtgttcgtggccgccgagaagcagtggaccatgctggaccgcaagtccaagcgccccgacaccctgatggaccccttcggcgtggaccgcgtggtgcaggacggcgtggtgttccgccagtccttctccatccgctcctacgagatcggcgccgaccgcaccgcctccatcgagaccctgatgaacatcttccaggagacctccctgaaccactgcaagtccatcggcctgctgaacgacggcttcggccgcacccccgagatgtgcaagcgcgacctgatctgggtggtgaccaagatgcacatcgaggtgaaccgctaccccacctggggcgacaccatcgaggtgaacacctgggtgtccgagtccggcaagaccggcatgggccgcgactggctgatctccgactgccacaccggcgagatcctgatccgcgccacctccgtgtgcgccatgatgaaccagaccacccgccgcttctccaagttcccctacgaggtgcgccaggagctggccccccacttcgtggactccgcccccgtgatcgaggactaccagaagctgcacaagctggacgtgaagaccggcgactccatctgcaacggcctgaccccccgctggaacgacctggacgtgaaccagcacgtgaacaacgtgaagtacatcggctggattctggagtccgtgcccaaggaggtgttcgagacccaggagctgtgcggcctgaccctggagtaccgccgcgagtgcggccgcgactccgtgctgaagtccgtgaccgccatggacccctccaaggagggcgaccgctccctgtaccagcacctgctgcgcctggaggacggcaccgacatcgccaagggccgcaccaagtggcgccccaagaacgccggcaccaacggcgccatctccaccggcaagacctccaacggcaactccatctcctga

SEQ ID NO: 146 - protein, 398 aa, Cuphea calophylla
MASAAFTMSACPAMTGRAPGARRSGRPVATRLRGRAPKANGSAVSLKSGSLDTQEDTSSSSSPPRTFINQLPDWSMLLSAITTVFVAAEKQWTMLDRKSKRPDTLMDPFGVDRVVQDGVVFRQSFSIRSYEIGADRTASIETLMNIFQETSLNHCKSIGLLNDGFGRTPEMCKRDLIWVVTKMHIEVNRYPTWGDTIEVNTWVSESGKTGMGRDWLISDCHTGEILIRATSVCAMMNQTTRRFSKFPYEVRQELAPHFVDSAPVIEDYQKLHKLDVKTGDSICNGLTPRWNDLDVNQHVNNVKYIGWILESVPKEVFETQELCGLTLEYRRECGRDSVLKSVTAMDPSKEGDRSLYQHLLRLEDGTDIAKGRTKWRPKNAGTNGAISTGKTSNGNSIS

SEQ ID NO: 147 - DNA, 1275 bp, Ricinus communis
atggccaccgcatccactttctcggcgttcaatgcccgctgcggcgacctgcgtcgctcggcgggctccgggccccggcgcccagcgaggcccctccccgtgcgcgggcgcgccgcctccaccctgaagtccggctccaaggaggtggagaacctgaagaagcccttcatgcccccccgcgaggtgcacgtgcaggtgacccactccatgcccccccagaagatcgagatcttcaagtccctggacaactgggccgaggagaacatcctggtgcacctgaagcccgtggagaagtgctggcagccccaggacttcctgcccgaccccgcctccgacggcttcgacgagcaggtgcgcgagctgcgcgagcgcgccaaggagatccccgacgactacttcgtggtgctggtgggcgacatgatcaccgaggaggccctgcccacctaccagaccatgctgaacaccctggacggcgtgcgcgacgagaccggcgcctcccccacctcctgggccatctggacccgcgcctggaccgccgaggagaaccgccacggcgacctgctgaacaagtacctgtacctgtccggccgcgtggacatgcgccagatcgagaagaccatccagtacctgatcggctccggcatggacccccgcaccgagaactccccctacctgggcttcatctacacctccttccaggagcgcgccaccttcatctcccacggcaacaccgcccgccaggccaaggagcacggcgacatcaagctggcccagatctgcggcaccatcgccgccgacgagaagcgccacgagaccgcctacaccaagatcgtggagaagctgttcgagatcgaccccgacggcaccgtgctggccttcgccgacatgatgcgcaagaagatctccatgcccgcccacctgatgtacgacggccgcgacgacaacctgttcgaccacttctccgccgtggcccagcgcctgggcgtgtacaccgccaaggactacgccgacatcctggagttcctggtgggccgctggaaggtggacaagctgaccggcctgtccgccgagggccagaaggcccaggactacgtgtgccgcctgcccccccgcatccgccgcctggaggagcgcgcccagggccgcgccaaggaggcccccaccatgcccttctcctggatcttcgaccgccaggtgaagctgatggactacaaggaccacgacggcgactacaaggaccacgacatcgactacaaggacgacgacgacaagtga

SEQ ID NO: 148 - protein, 424 aa, Ricinus communis
MATASTFSAFNARCGDLRRSAGSGPRRPARPLPVRGRAASTLKSGSKEVENLKKPFMPPREVHVQVTHSMPPQKIEIFKSLDNWAEENILVHLKPVEKCWQPQDFLPDPASDGFDEQVRELRERAKEIPDDYFVVLVGDMITEEALPTYQTMLNTLDGVRDETGASPTSWAIWTRAWTAEENRHGDLLNKYLYLSGRVDMRQIEKTIQYLIGSGMDPRTENSPYLGFIYTSFQERATFISHGNTARQAKEHGDIKLAQICGTIAADEKRHETAYTKIVEKLFEIDPDGTVLAFADMMRKKISMPAHLMYDGRDDNLFDHFSAVAQRLGVYTAKDYADILEFLVGRWKVDKLTGLSAEGQKAQDYVCRLPPRIRRLEERAQGRAKEAPTMPFSWIFDRQVKLMDYKDHDGDYKDHDIDYKDDDDK

SEQ ID NO: 149 - DNA, 2678 bp, Artificial Sequence
  synthetic polynucleotide
gctcttcccgcaccggctggctccaccccaacttgaacctcgagaaccccgcgcctggcgtcgaccccgtcgtgctcgtggggccgcggaaggagcgcgccgaagacctggacgtcgtcctctccaactcctttggctttggcgggcacaattcgtgcgtcggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcgtagagctcatcttccgaaagtacgacgagtgagcgagctgattctctttgagcggggtcgggtggttcggggagagtgcgcggaaaggcgcagagacgtgcggccggccgtgtccctccgtcttcccctggttggtgctatagtaacctgcctgtgtcgcgtgcgcgtcgggaagagc

SEQ ID NO: 150 - DNA, 1113 bp, Botryococcus braunii
aattggaaaccccgcgcaagaccgggttgtttggccgcctgaccggaaagggggggcctgtcccgaagggggtctatctcttgggggatgtcgggcgcggaaagtcgatgttgatggacctcttcttcgaccatgtcggggtcgaggccaagagccgcgtccatttcgccgagttcatgatggaggtgaatgaccgcatcgccaccgaacgcgccaagaagcgggcgaccgatcgcccccgtcgctgcagcccttgccgaggaagtccggctgctggcgttcgacgagatgatggtgacgaacagcccggacgcgatgatcctgtcgcggctgttcaccgcgctgatcgaggcgggggtgacgatcgtcaccacctccaaccggccgcccagggatctctataagaacgggctcaaccgcgagcatttcctgcccttcatcgcgctgatcgaggcgcggctggacgtgctggcgctgaacggcccgaccgactatcggcgcgaccggctggggcggctggacacgtggttggtgcccaatggccccaaggcgacgattaccttgtcggcggcgttcttccgcctgaccgactatccggtcgaggatgccgcgcatgtgccctctgaggacctgaaggtgggcgggcgcgtgctgaatgtccccaaggcgctgaagggcgtcgcggtcttctcgttcaagcggttgtgcggcgaagcgcggggggcggcggactatctggcggtcgcgcggggcttccacaccgtcatcctggtcggaatccccaagctgggggcggagaaccgcaacgaggcggggcgcttcgtccagctgatcgacgcgctctacgaacataaggtcaagctgctcgccgcagccgatgccagcccgccgaactctatgaaaccggcgacggccggttcgagtttgagcgcagatcagccggttggaagagatgcgctccgaggattatctggcccaaggccatggctcggaggggccttgatcaggccttaatgcacttcgcaaccattatcgtttaaaatcttaaactctgtggaataacggttccccgacgccgcaatacacgtacgtccactacggagtaggattgga

SEQ ID NO: 151 - DNA, 253 bp, Chlamydomonas reinhardtii
cgcttagaagatttcgataaggcgccagaaggagcgcagccaaaccaggatgatgtttgatggggtatttgagcacttgcaacccttatccggaagccccctggcccacaaaggctaggcgccaatgcaagcagttcgcatgcagcccctggagcggtgccctcctgataaaccggccagggggcctatgttctttacttttttacaagagaagtcactcaacatcttaaacggtcttaagaagtctatccgg

SEQ ID NO: 152 - DNA, 2435 bp, Artificial Sequence
  synthetic polynucleotide
ggatccccgggaattcggcgcgccgggcccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcgg

SEQ ID NO: 153 - DNA, 20 bp, Artificial Sequence
  synthesized primer
caaccacgtcttcaaagcaa

SEQ ID NO: 154 - DNA, 20 bp, Artificial Sequence
  synthetic primer
agcaatcgcgcatatgaaat

SEQ ID NO: 155 - DNA, 1412 bp, Chlorella protothecoides
gaattcgagtttaggtccagcgtccgtggggggggacgggctgggagcttgggccgggaagggcaagacgatgcagtccctctggggagtcacagccgactgtgtgtgttgcactgtgcggcccgcagcactcacacgcaaaatgcctggccgacaggcaggccctgtccagtgcaacatccacggtccctctcatcaggctcaccttgctcattgacataacggaatgcgtaccgctctttcagatctgtccatccagagaggggagcaggctccccaccgacgctgtcaaacttgcttcctgcccaaccgaaaacattattgtttgagggggggggggggggggcagattgcatggcgggatatctcgtgaggaacatcactgggacactgtggaacacagtgagtgcagtatgcagagcatgtatgctaggggtcagcgcaggaagggggcctttcccagtctcccatgccactgcaccgtatccacgactcaccaggaccagcttcttgatcggcttccgctcccgtggacaccagtgtgtagcctctggactccaggtatgcgtgcaccgcaaaggccagccgatcgtgccgattcctggggtggaggatatgagtcagccaacttggggctcagagtgcacactggggcacgatacgaaacaacatctacaccgtgtcctccatgctgacacaccacagcttcgctccacctgaatgtgggcgcatgggcccgaatcacagccaatgtcgctgctgccataatgtgatccagaccctctccgcccagatgccgagcggatcgtgggcgctgaatagattcctgtttcgatcactgtttgggtcctttccttttcgtctcggatgcgcgtctcgaaacaggctgcgtcgggctttcggatcccttttgctccctccgtcaccatcctgcgcgcgggcaagttgcttgaccctgggctggtaccagggttggagggtattaccgcgtcaggccattcccagcccggattcaattcaaagtctgggccaccaccctccgccgctctgtctgatcactccacattcgtgcatacactacgttcaagtcctgatccaggcgtgtctcgggacaaggtgtgcttgagtttgaatctcaaggacccactccagcacagctgctggttgaccccgccctcgcaactccctaccatgtctgctggtaggtccagggatctttgccatgcacacaggaccccgtttgtgggggtccccggtgcatgctgtcgctgtgcaggcgccggtgtggggcctgggccccgcgggagctcaactcctccccatatgcctgccgtccctcccacccaccgcgacctggccccctttgcagaggaaggcgaagtcagcgccatcgtgtgcgataatggatccgg

SEQ ID NO: 156 - DNA, 1627 bp, Chlorella protothecoides
gaattcgcccttgagtttaggtccagcgtccgtggggggggcgtgagactcccccctgaccttcgtatggcagggactcctacttgccaagtaatcagttgacaatgccacttcaatgctcgttgtggtacactgacgcgggtctaacatactgggaagcatgaattgccgacatggactcagttggagacagtaacagctctttgtgttctatcttcaggaacacatttggcagcgcacccatacagtggcgcacacgcagctgtacctgatgtggctctattcccacatgtttcaacttgatccaaaagtcactcagactctcagcagctagacttgatcgcatctttggccatgaagatgcttgcgcaactctaggaatgggacgagaaaagagcctgctctgatcggatatttccattctctggatgggactgagatgattctgaagaaatgctgctcgacttatttggaagaacagcacctgacgcatgctttgaggctgctgtggctgggatgtgctgtatttgtcagcattgagcatctacgggtagatggccataaccacgcgctgcctatcatgcggtgggttgtgtggaaaacgtacaatggacagaaatcaatcccattgcgagcctagcgtgcagccatgcgctccctctgtagccccgctccaagacaaagccagccaatgccagaacccacatagagagggtatcttcctaatgacctcgcccatcatttcctccaaattaactataatgccttgattgtggagttggctttggcttgcagctgctcgcgctggcacttttgtaggcagcacagggtatgccagcgccgaactttgtgcccttgagcaggccacaagggcacaagactacaccatgcagctggtatacttggaactgataccattcttaccaagcaaggcacagcacagcctgcaccgactcactttgcttgagcggggcacagcgccgcgactgatcctgcgagctgtggggagttccgactgttctggacctcggtctctgaaagatgtgtacgatgggatcaagtcattcaagtatgctcttcacatgagcaatcgggggagacacggtggccctaaaggtgttcatctgattcaagtgtagtgggggggtgctgtttgtcccggggcgccccccgctccccgaccccggagaagggccccagaggactcggccgcccacagaggaataaccgggcgtggctcggccctgcgcctccctctttcaatatttcacctggtgttcagtgcacggacacgtaaagaactagatacaatggccgagggaaagacggtgagagcttggcgttggtggaccgggcagcatcagaaactcctcttccccgcccgccttgaaactcactgtaactccctcctcttccccctcgcagcatctgtctatcgttatcgtgagtgaaagggactgccatgtgtcgggtcgttgaccacggtcggctcgggcgctgctgcccgcgtcgcgaacgttccctgcaaacgccgcgcagccgtccctttttctgccgccgccccaccccctcgctccccccttcaatcacaccgcagtgcggacatgtcgattccggcaagtccacc

SEQ ID NO: 157 - DNA, 570 bp, Chlorella protothecoides
gaattccctgcaggaagaaggccggcagcagctggtacttgtccttcacctccttgatcggctgggtgagcttggccgggtcgcagtcgtcgatgccggcatcgcccagcacgctgtgcggggagccggcatcgacaaccttggcactgctcaccttggtcaccggcatggggtcatggcgctgcagaccagcggcctgtcagcatgctgcaggcatctgtgttttgtagtagatactttctgatgcatcaccacacgtttggaaggtccccaagccccttcaacagtctcgacatatgacactcgcgccctcttcctcgtcccgtggcctgatgagggtacgcaggtaccgcagctgcgccccgtcccgccagttgccctggccccgccgggcccaatctgttcattgccgctccctggcagccgtgaacttcacactaccgctctctgtgaccttcagcacagcaggaatcgccatttcaccggcggtcgttgctgcggagcctcagctgatctcgcctgcgagaccccacagtttgaatttgcggtccccacacaacctctgacgcc

SEQ ID NO: 158 - DNA, 568 bp, Chlorella protothecoides
  misc_feature (133)..(133): n is a, c, g, or t
gaattccctcaggaagaaggccggcagcagctggtacttgtccttcacctccttgatcggctgggtgagcttcgcaggatcgcagtcgtcgatgccggcatcgcccagcacgctgtgcggggagccggcatcnacaaccttggcactgctccccttggtcaccggcatggggtcatggcgctgcagcccagcggcctgtcagcatgctgcaggcatctgtgtattgtagtaggtacttcctgatgcatcaacacacgtttggaagctccccaagccccttcaacagtctcgacgtatgacactcgcgccctcttcctcgccccgtggcctgatgagggtacgcaggtaccacagctgcgccccgtcccgccagttgccctggcccggccgggcccaatctgttcattgccgctccctggtagccgtgaactcacattaccgctctctgtgaccttcagcacagcaggaatcgccatttcaccggcggtcgttgctgcggagcctcagctgatctcgcctgcgagaccccacagtttgaatttgcggtccccacacaacctctgacgcc

SEQ ID NO: 159 - DNA, 1292 bp, Chlorella protothecoides
atcaaaggcatagattcacatttgttggcattgcagagcaatcatcgcgcaggacgaacatcgctcaccaagcacgtactgggcatccggaggcctccgcaaattcctgcaacaggactcgctgatcagttcgcccaaggtctacgacgctccctatcggcgctagacttcaacacatatttcactgtcacagcctcggcatgcatcaggcctcagtctccaccatgaagaccatccagtctcggcacgccggtcccatcggacatgtgcagtcgggtcgccgatcggcggggcgcgcgggatcccgcatggcgacccccgtggccgcagctaccgtcgcagcccctcgctcggccctcaacctctcccccaccatcattcgacaggaggtgctccactccgccagcgcccagcaactagactgcgtggcctccctggcgcccgtcttcgagtcccagatcctccccctcctgacgcccgtggacgagatgtggcagcccaccgacttcctccccgcctcgaactcggaggcattcttcgaccagatcggcgacctgcgggcgcgatcggcggccatccccgacgacctgctggtctgcctggtgggggacatgatcacggaggaggccctgcccacctacatggccatgctgaacaccctggacgtcgtgcgcgatgagacagggcacagccagcacccctacgccaagtggaccagggcttggatcgcggaggagaaccgccatggcgacctgctgaacaagtacatgtggctgacggggcgggtgggacatgctggcggtggagcgcaccatccagccatgctggcggtggagcgcaccatccagcgcctcatctcatcgggcatggacccgggcacggagaaccacccctaccacgcctttgtgttcaccagcttccaggagcgcgccaccaagctgagccacggctccaccgcccgcctggcggtcgccgccggggacgaggccctggccaagatctgcgggaccattgcgcgggacgagtcgcgccacgaggcggcgtacacgcggaccatggatgccatcttccagcgcgaccccagcggggccatggtggcgtttgcgcacatgatgatgcgcaagatcaccatgcccgcccacctcatggacgacggccagcacggcgcgcgcaacgggggggcgcaacttgttcgacgactttgcggcagtggcggagcgggcaggggtgtacaccgccggcgactacatcggcatcctgcgccacctcatccggcgctgggacgtggaggg

SEQ ID NO: 160 - protein, 364 aa, Chlorella protothecoides
MHQASVSTMKTIQSRHAGPIGHVQSGRRSAGRAGSRMATPVAAATVAAPRSALNLSPTIIRQEVLHSASAQQLDCVASLAPVFESQILPLLTPVDEMWQPTDFLPASNSEAFFDQIGDLRARSAAIPDDLLVCLVGDMITEEALPTYMAMLNTLDVVRDETGHSQHPYAKWTRAWIAEENRHGDLLNKYMWLTGRVGHAGGGAHHPAMLAVERTIQRLISSGMDPGTENHPYHAFVFTSFQERATKLSHGSTARLAVAAGDEALAKICGTIARDESRHEAAYTRTMDAIFQRDPSGAMVAFAHMMMRKITMPAHLMDDGQHGARNGGAQLVRRLCGSGGAGRGVHRRRLHRHPAPPHPALGRGG

SEQ ID NO: 161 - DNA, 1395 bp, Chlorella protothecoides
attatacatcggcatcgtctcaggtttcacgatctgcatgctatctatgggactgtgactccgccggccaggttgtggtgcgcgagaatcctccccgctcctgccttctcatttccctgacgggagtcgccgctgagcaccgggcggatcatgggcgtcggcacactccaaaccccatatacatgtggtcgtgcattcacgcatagcgcacggtatgtcccgcgacgcgcggctcgaagccgtggccatccgacgcgctgcacggccgaggtgagggcacgcccctccgccaatggcgcgcagcccatgaccgccttcgacttccggcagtacatgcagcagcgcgccgcgctggtggacgcagcgctggacctggcagtgccgctgcagtaccccgagaagatcaacgaggccatgcggtacagcctgctggccgggggcaagcgcgtgcgccccgcgctctgcctcgctgcctgcgagctcgtgggcggccccctggaggcggccatgcccgccgcctgcgccatggagatgatccacaccatgagcctcatccacgacgacctccccgccatggacaacgacgacttccggcgcggccagcccgccaaccacaaggcctatggcgaggagattgcgatcctggcgggcgacgcgctgctgtcgctgagctttgagcacatcgcgcgcgagacgcgaggcgtggacccggtgcgcgtcctggccgccatctcggagtggcgcgcggtgggcagccgcgggctggtggcggggcaggtggtggacctgggtttcgagggcggcggcgtggggctggccccgctgcgctacatccacgagcacaaaaccgcggcgctgctggaggcggcggtggtgtccggcgcgctgctgggcggcgcggaggaggcggacctggagcgcctgcgcacctacaaccgcgccatcggcctcgctttccaggtggtgggggacatcctggacatcccggggaccagcgaggagctgggcaagaccgcgggcaaggacctgagctcccccaaaaccccctacccgtccctggtggggctggccaggtccaaaaaaattgcggacgaactgattgaggacgcgaaaacccaactcacccagtacgagccggcccgagcggcgcccctcgtaaccctggccgaaaacatttgaaaccggaagaactgactgggggccccccctgcccccagatacggcggggctcctccatccagttttgggatgggaggagcgacaaccgaccccgtaaccctgtgacgcgtttgccttgcatacgtacgcatgccttgaaacccatccatgaccctcaacaatacctggttgtgtgtagcttggtcctgaaaaaaaaaaaaaaaaaaaaaaaaaaaa

SEQ ID NO: 162 - protein, 342 aa, Chlorella protothecoides
MGVGTLQTPYTCGRAFTHSARYVPRRAARSRGHPTRCTAEVRARPSANGAQPMTAFDFRQYMQQRAALVDAALDLAVPLQYPEKINEAMRYSLLAGGKRVRPALCLAACELVGGPLEAAMPAACAMEMIHTMSLIHDDLPAMDNDDFRRGQPANHKAYGEEIAILAGDALLSLSFEHIARETRGVDPVRVLAAISEWRAVGSRGLVAGQVVDLGFEGGGVGLAPLRYIHEHKTAALLEAAVVSGALLGGAEEADLERLRTYNRAIGLAFQVVGDILDIPGTSEELGKTAGKDLSSPKTPYPSLVGLARSKKIADELIEDAKTQLTQYEPARAAPLVTLAENI

SEQ ID NO: 163 - DNA, 833 bp, Chlorella protothecoides
cagatgccatgcgccctcgggccgcgggcctgagggtccacgcagcgtcctcggtggcccagacgcaccaggccgcccccccggcggacaggaggttcgacgactaccagccccgcaccgccatcctcttccccggccagggcgcgcagagcgtgggcatggcgggagagctggcgaaggccgtccccgccgccgcggcgctgttcgacgccgcctccgaccagctcggctatgacctgctccgcgtgtgcgttgagggccccaaggcgcgcctggacagcaccgccgtcagccagcccgccatctacgtggccagcctggcggcggtggagaagctgcgcgcggagggcggggaggaggcactggccgccatcgacgtcgctgccggtctgtccttgggcgagtacaccgcgctggcctttgccggcgccttctccttcgccgacgggctgcgcctggtggccctgcgcggcgccagcatgcaggccgccgccgacgccgcaccctcgggcatggtctccgtcatcggtctgccctccgacgcggtggccgcgctgtgcgaggccgccaacgcgcaggtggcccccgaccaggccgtgcgcatcgccaactacctctgcgacggcaactacgccgtcagcggtgggctggagggctgcgcggcggtggagggcctggccaaggcccacaaggcgcgcatgacggtgcgcctggcggtggcgggcgccttccacacccccttcatgcagccggcggtggaggcgctgagcgcgggcgctggcggacacgccgctggtcgcgccgcgcatccccgtggtcagcaacgggacgcc

SEQ ID NO: 164 - protein, 275 aa, Chlorella protothecoides
MRPRAAGLRVHAASSVAQTHQAAPPADRRFDDYQPRTAILFPGQGAQSVGMAGELAKAVPAAAALFDAASDQLGYDLLRVCVEGPKARLDSTAVSQPAIYVASLAAVEKLRAEGGEEALAAIDVAAGLSLGEYTALAFAGAFSFADGLRLVALRGASMQAAADAAPSGMVSVIGLPSDAVAALCEAANAQVAPDQAVRIANYLCDGNYAVSGGLEGCAAVEGLAKAHKARMTVRLAVAGAFHTPFMQPAVEALSAGAGGHAAGRAAHPRGQQRDA

SEQ ID NO: 165 - DNA, 787 bp, Chlorella protothecoides
tgtccatctccccccaccctccatccaaccatcgtcgacggcatgcaggcgctgtgttctcaccccgcgtccctcacggcgcgtgcggtaccccatgggcgggccagcccagcacagcgggtgtccagcgccggcccggcctacaccggcctgtcccggcacaccctgggctgccccagcacccccaccctccagtcccgcgccgcggtccagacccgcggctcctcctccggctccaccacgcgcatgaccaccaccgcccagcgcaagatcaaggtggccatcaacgggttcggccgcatcggccgccagttcctgcgctgcgtggaggggcgcgaggactcgctgctggagatcgtggccgtgaacgactccggcggcgtgaagcaggccagccacctgctcaagtacgactccaccatgggcaccttcaacgccgacatcaagatctcgggcgagggcaccttctccgtcaacggccgcgacatccgcgtcgtctcctcccgcgaccccctggccctgccctggggcgagctgggcgtggacctggtgatcgaggggacgggagtgtttgtggaccgcaagggtgccagcaagcacctgcaggcgggggccaagaaggtcatcatcaccgcgccggccaagggctccgacgtgcccacctacgtcatgggcgtgaacgcggaccagtactccaactccgacgacatcatctccaacgcctcctgcaccaccaactgcctggcgccctttgtcaaggtgctcaacgaccgcttcggcatcgtga

SEQ ID NO: 166 - protein, 248 aa, Chlorella protothecoides
MQALCSHPASLTARAVPHGRASPAQRVSSAGPAYTGLSRHTLGCPSTPTLQSRAAVQTRGSSSGSTTRMTTTAQRKIKVAINGFGRIGRQFLRCVEGREDSLLEIVAVNDSGGVKQASHLLKYDSTMGTFNADIKISGEGTFSVNGRDIRVVSSRDPLALPWGELGVDLVIEGTGVFVDRKGASKHLQAGAKKVIITAPAKGSDVPTYVMGVNADQYSNSDDIISNASCTTNCLAPFVKVLNDRFGIV

SEQ ID NO: 167 - DNA, 860 bp, Chlorella protothecoides
gatgttgagaatagtagcttgctgccttgtcgccatgcagagcgtgtgcgcgcagtcggtttcatgcaagggggccttcacccagtccctgcggaccccccgatgcagcaggagccagctcgtctgccgggctgatggcaaggccggagccttcatcaagaccgtaaagagcggtgctgccgctctggctgcctccctcctcctgtctgggggtgcgggcgcactgacctttgatgagctgcagggcctgacctacctgcaggtgaagggctctggcatcgccaacacctgccccaccctgtctggcggctcctccaacatcaaggacctgaagagcgggacctactccgtcaacaagatgtgcctggagcccacgtccttcaaggtcaaggaggaggcacagttcaagaacggcgaggccgactttgtgcccaccaagctcgtcacgcgtctgacctacaccctggacgagatctctggccagatgaagatcgacggcagcggcggcgtggagttcaaggaggaggatggcatcgactatgctgcagtcaccgtgcagcttccgggcggggagcgcgtgcccttcctcttcaccatcaaggagcttgacgccaaggggactgccgacggcttcaagggcgagttcaccgtgccctcctaccgtgggtcctccttcctggaccccaagggccgcggcgcctccaccggctacgacaacgccgtggccctgcccgccgccggcgattccgaggagttggagaaggagaacaacaagtccaccaaggctctgaagggggaggccatcttctccatcgccaaggtggacgccgggacaggggaggtggcgggcatctttgagt

SEQ ID NO: 168 - protein, 275 aa, Chlorella protothecoides
MQSVCAQSVSCKGAFTQSLRTPRCSRSQLVCRADGKAGAFIKTVKSGAAALAASLLLSGGAGALTFDELQGLTYLQVKGSGIANTCPTLSGGSSNIKDLKSGTYSVNKMCLEPTSFKVKEEAQFKNGEADFVPTKLVTRLTYTLDEISGQMKIDGSGGVEFKEEDGIDYAAVTVQLPGGERVPFLFTIKELDAKGTADGFKGEFTVPSYRGSSFLDPKGRGASTGYDNAVALPAAGDSEELEKENNKSTKALKGEAIFSIAKVDAGTGEVAGIFE

SEQ ID NO: 169 - DNA, 818 bp, Chlorella protothecoides
ataatcggaacccagctgcacgcaccatcagtgcggcagcatgcagaccgtcgcagccagctatggcgtattggcgccctccggctccagcgtgacccggggctcgaccagcagcaagcagcacttcaccaccctcactcccttttccggcttcaggcgcctgaatcatgtggatcgggcggggcaggcggggtctgggagcccccagaccctgcagcaggccgtgggcaaggccgtgcgccggtcgcggggccgcaccaccagcgccgtgcgcgtgacccgcatgatgtttgagcggttcaccgagaaggccatcaaggtggtcatgctcgcgcaggaggaggctcgccgtctgggccacaacttcgtggggacggagcaaatcctgctggggttgattggggagtccacaggcatcgccgccaaggtcctcaagtcgatgggcgtcacgctgaaagatgcgcgtgtggaggtcgagaagatcatcggccgggggagcggctttgtggccgtggagatccccttcaccccccgcgccaagcgtgtgctggagctgtccctggaggaggctcgccagctcggccacaactacattggcacggagcacatcctgctgggcctgctgcgcgagggtgagggcgtggcctcccgcgtgctggagaccctgggcgccgacccccagaagatccgcactcaggtggtacgcatggtgggtgagtcgcaggagcccgtgggcaccacggtgggcggagggtccaccggctccaacaagatgcccaccctggaggagtacggcaccaacctgaccgcccaggccg

SEQ ID NO: 170 - protein, 259 aa, Chlorella protothecoides
MQTVAASYGVLAPSGSSVTRGSTSSKQHFTTLTPFSGFRRLNHVDRAGQAGSGSPQTLQQAVGKAVRRSRGRTTSAVRVTRMMFERFTEKAIKVVMLAQEEARRLGHNFVGTEQILLGLIGESTGIAAKVLKSMGVTLKDARVEVEKIIGRGSGFVAVEIPFTPRAKRVLELSLEEARQLGHNYIGTEHILLGLLREGEGVASRVLETLGADPQKIRTQVVRMVGESQEPVGTTVGGGSTGSNKMPTLEEYGTNLTAQA

SEQ ID NO: 171 - DNA, 20 bp, Artificial Sequence
  synthetic primer
tccggtgtgttgtaagtcca

SEQ ID NO: 172 - DNA, 20 bp, Artificial Sequence
  synthetic primer
ttgtcggaatgtcatatcaa

SEQ ID NO: 173 - DNA, 20 bp, Artificial Sequence
  synthetic primer
aacgcctttgtacaactgca

SEQ ID NO: 174 - DNA, 29 bp, Artificial Sequence
  synthetic primer
ctgacccgacctatgggagcgctcttggc

SEQ ID NO: 175 - DNA, 28 bp, Artificial Sequence
  synthetic primer
cttgacttccctcacctggaatttgtcg

SEQ ID NO: 176 - DNA, 20 bp, Artificial Sequence
  synthetic primer
gtggccatatggacttacaa

SEQ ID NO: 177 - DNA, 41 bp, Artificial Sequence
  synthetic primer
caagggctggatgaatgaccccaatggactgtggtacgacg

SEQ ID NO: 178 - DNA, 32 bp, Artificial Sequence
  synthetic primer
cacccgtcgtcatgttcacggagcccagtgcg

SEQ ID NO: 179 - DNA, 3681 bp, Artificial Sequence
  synthesized polynucleotide
gccctttgtcatcgttggcatgctttttgcgtatgtaccatatgttgaatgtataatacgaacggttgaccgtctgagatgcgagctttgggtcttgtcaaatgcgtggccgcacggctccctcgcacccagccccgaggcgtcgcgcacctggcgaggagcagacccacgccaagaaagtctagtccagcatgtaacaacatcaggcaatgtgacgttttcggttcccgatttctctgccgctctttgacggcaggcacgggcgagcaaccggcggcgctcgcgtcaggcacgatggatgcggcgctgcccacctgtcaatgtaccccaccagtctgtcgatcgctacaagcaaccttgtgctccacattcccacttgcagacagtctagtcgattttgccaagctggatgtgaggattggccatatcttggaggccaagattcacccggatgctgatgggtacgtacgcgagccaggcaggcagctgcgttgactttctgattggcacaaagctttggctactctcaataccaaccacgtgccccttctgcacacctgcttccttctgatgaccactcgccacgcatgtcgcagtctgtacgtcgagcagatcgacctcggcgaggaggggggccctcgcaccatcgtgagtggcctggtccggcacgtgaccctggaggaccttgtcggccggcgggtggtggtgctggccaacctcaagcctcggagcatgcgcggggtcaaatcggctgggatgctgctctgcgccgccaacgcggatcacaccgcggtggagccgctgcgggtcccggacgccgccgtgacgggggagcgggtctgggcgggggacgaggcactcctgtccacggagcctgccacacccaatcaggtaaggacacgttattggtgcgcatggtgcgaatgcgtggtctgacctgctgtgggtatgtgttgtgggattggaaaccgaatgagggccgttcaggattgagcccttggccccaccctgctcatcctctcacgcccgcaggtccagaagaagaaaatctgggaggcagtacagccgctgctgagagtgaacgcccaggggatcgctactgtggcaggagaggctatggtgaccagtgcggggccactgaccgcgcccacgctggttgacgccgcgatttcctgacgcgagcgactgattcttgacctttgagaagccaccacagcaccattttcattgttcatccttgatttcagtacgacttctcaccatttcagtactgtaggacccccaaaatagtgtgatcacgctcgcaaggcacctgtgtgatcacggggaagggcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctt

SEQ ID NO: 180 - DNA, 3669 bp, Artificial Sequence
  synthesized polynucleotide
cccgtgatcacacaggtgccttgcgagcgtgatcacactattttgggggtcctacagtactgaaatggtgagaagtcgtactgaaatcaaggatgaacaatgaaaatggtgctgtggtggcttctcaaaggtcaagaatcagtcgctcgcgtcaggaaatcgcggcgtcaaccagcgtgggcgcggtcagtggccccgcactggtcaccatagcctctcctgccacagtagcgatcccctgggcgttcactctcagcagcggctgtactgcctcccagattttcttcttctggacctgcgggcgtgagaggatgagcagggtggggccaagggctcaatcctgaacggccctcattcggtttccaatcccacaacacatacccacagcaggtcagaccacgcattcgcaccatgcgcaccaaataacgtgtccttacctgattgggtgtggcaggctccgtggacaggagtgcctcgtcccccgcccagacccgctcccccgtcacggcggcgtccgggacccgcagcggctccaccgcggtgtgatccgcgttggcggcgcagagcagcatcccagccgatttgaccccgcgcatgctccgaggcttgaggttggccagcaccaccacccgccggccgacaaggtcctccagggtcacgtgccggaccaggccactcacgatggtgcgagggcccccctcctcgccgaggtcgatctgctcgacgtacagactgcgacatgcgtggcgagtggtcatcagaaggaagcaggtgtgcagaaggggcacgtggttggtattgagagtagccaaagctttgtgccaatcagaaagtcaacgcagctgcctgcctggctcgcgtacaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcggtacccgtacccatcagcatccgggtgaatcttggcctccaagatatggccaatcctcacatccagcttggcaaaatcgactagactgtctgcaagtgggaatgtggagcacaaggttgcttgtagcgatcgacagactggtggggtacattgacaggtgggcagcgccgcatccatcgtgcctgacgcgagcgccgccggttgctcgcccgtgcctgccgtcaaagagcggcagagaaatcgggaaccgaaaacgtcacattgcctgatgttgttacatgctggactagactttcttggcgtgggtctgctcctcgccaggtgcgcgacgcctcggggctgggtgcgagggagccgtgcggccacgcatttgacaagacccaaagctcgcatctcagacggtcaaccgttcgtattatacattcaacatatggtacatacgcaaaaagcatg

SEQ ID NO: 181 - DNA, 3850 bp, Artificial Sequence
  synthesized polynucleotide
tttggccccgctttccagctccggatctgctggcgtccgccgcgagacgtgacatcgcacgtcgccgggagcgccagcttgatcacttggcagggggccgtgctctacaaataccaggccccgcggcggtcagttcgcacatccaatacctgccgagccatcttgcctacactttttatcgactcctctactctgttcgcgagagcgctcggtccaggcttggaattcgccgaattcagctcgatcagtcgcttctgcaactgatctcggccgttcgcagactgccttttctcagcttgtcaggtagcgagttgttgttttatatttattcgatttcatctgtgttgcatgtcttgttcgtgctgtgcgttctttctgggccgcgctgtcgggtcgcatgggctagctgtactcatgttagtcatgccggtccgaccttgttcgaggaaggccccacactgagcgtgccctctttctacaccccttgtgcagaaattagatagaaagcagaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaccgacacgcccccggcccaggtccagttctcctgggtcttccagaggcccgtcgccatgtaaagtggcagagattggcgcctgattcgatttggatccaaggatctccaatcggtgatggggactgagtgcccaactaccacccttgcactatcgtcctcgcactatttattcccaccttctgctcgccctgccgggcgattgcgggcgtttctgcccttgacgtatcaatttcgcccctgctggcgcgaggattcttcattctaataagaactcactcccgccagctctgtacttttcctgcggggcccctgcatggcttgttcccaatgcttgctcgatcgacggcgcccattgcccacggcgctgccgcatccatgtgaagaaacacggaagagtgcgaagactggaagtgaattaagagtataagaagaggtaccaagggattctcaggtgctcttaggaacggcttttccttcgccaagagaaactgctactgctcgtgtcgccacggtggtcaagccgccccatctgcgatccaccaggcccatccgcggactcgcgatcagcctgctggatccggactgccgacctgaccgctcgcatccaccattacaaccctccaattggacaccactcccacgtcctaaagttcaccatgcaagctgatcgatcgcattcgccgatgcactcgcctgccacagaggtgtgcgcttcggactagcgtgcaggcgccccgaggccaccagcatgcaccgatggaagcgggcacggccgctgctccaggtcgctggctcgctcagacccatagcaacctccgctgcgtccctaaatgtcacacagagcgtctttgatgggtacggatgggagagaatctgattgggcattgctggtgcagtgcaggaagatggcaagtgcacagtcagtcatgctgtacaaactggtgcctcgtagtattgactcgtatagtgcatagtatcatgcatggtcgttacttgcaa

SEQ ID NO: 182 - DNA, 3108 bp, Artificial Sequence
  synthesized polynucleotide
tttggccccgctttccagctccggatctgctggcgtccgccgcgagacgtgacatcgcacgtcgccgggagcgccagcttgatcacttggcagggggccgtgctctacaaataccaggccccgcggcggtcagttcgcacatccaatacctgccgagccatcttgcctacactttttatcgactcctctactctgttcgcgagagcgctcggtccaggcttggaattcgccgaattcagctcgatcagtcgcttctgcaactgatctcggccgttcgcagactgccttttctcagcttgtcaggtagcgagttgttgttttatatttattcgatttcatctgtgttgcatgtcttgttcgtgctgtgcgttctttctgggccgcgctgtcgggtcgcatgggctagctgtactcatgttagtcatgccggtccgaccttgttcgaggaaggccccacactgagcgtgccctctttctacaccccttgtgcagaaattagatagaaagcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgaccgacacgcccccggcccaggtccagttctcctgggtcttccagaggcccgtcgccatgtaaagtggcagagattggcgcctgattcgatttggatccaaggatctccaatcggtgatggggactgagtgcccaactaccacccttgcactatcgtcctcgcactatttattcccaccttctgctcgccctgccgggcgattgcgggcgtttctgcccttgacgtatcaatttcgcccctgctggcgcgaggattcttcattctaataagaactcactcccgccagctctgtacttttcctgcggggcccctgcatggcttgttcccaatgcttgctcgatcgacggcgcccattgcccacggcgctgccgcatccatgtgaagaaacacggaagagtgcgaagactggaagtgaattaagagtataagaagaggtaccaagggattctcaggtgctcttaggaacggcttttccttcgccaagagaaactgctactgctcgtgtcgccacggtggtcaagccgccccatctgcgatccaccaggcccatccgcggactcgcgatcagcctgctggatccggactgccgacctgaccgctcgcatccaccattacaaccctccaattggacaccactcccacgtcctaaagttcaccatgcaagctgatcgatcgcattcgccgatgcactcgcctgccacagaggtgtgcgcttcggactagcgtgcaggcgccccgaggccaccagcatgcaccgatggaagcgggcacggccgctgctccaggtcgctggctcgctcagacccatagcaacctccgctgcgtccctaaatgtcacacagagcgtctttgatgggtacggatgggagagaatctgattgggcattgctggtgcagtgcaggaagatggcaagtgcacagtcagtcatgctgtacaaactggtgcctcgtagtattgactcgtatagtgcatagtatcatgcatggtcgttacttgcaa

SEQ ID NO: 183 - protein, 398 aa, Cuphea wrightii
MVAAAASSAFFSVPTPGTSPKPGKFGNWPSSLSVPFKPDNGGFHVKANASAHPKANGSAVNLKSGSLETPPRSFINQLPDLSMLLSKITTVFGAAEKQWKRPGMLVEPFGVDRIFQDGVFFRQSFSIRSYEIGVDRTASIETLMNIFQETSLNHCKSIGLLNDGFGRTPEMCKRDLIWVVTKIQVEVNRYPTWGDTIEVNTWVSESGKNGMGRDWLISDCRTGEILIRATSVWAMMNQNTRRLSKFPYEVRQEIAPHFVDSAPVIEDDRKLHKLDVKTGDSIRDGLTPRWNDLDVNQHVNNVKYIGWILKSVPIEVFETQELCGVTLEYRRECGRDSVLESVTTMDPAKEGDRCVYQHLLRLEDGADITIGRTEWRPKNAGANGAISSGKTSNGNSVS

SEQ ID NO: 184 - protein, 408 aa, Cuphea wrightii
MVVAAAASSAFFPVPAPRPTPKPGKFGNWPSSLSQPFKPKSNPNGRFQVKANVSPHPKANGSAVSLKSGSLNTLEDPPSSPPPRTFLNQLPDWSRLRTAITTVFVAAEKQFTRLDRKSKRPDMLVDWFGSETIVQDGLVFRERFSIRSYEIGADRTASIETLMNHLQDTSLNHCKSVGLLNDGFGRTPEMCTRDLIWVLTKMQIVVNRYPTWGDTVEINSWFSQSGKIGMGREWLISDCNTGEILVRATSAWAMMNQKTRRFSKLPCEVRQEIAPHFVDAPPVIEDNDRKLHKFDVKTGDSICKGLTPGWNDFDVNQHVSNVKYIGWILESMPTEVLETQELCSLTLEYRRECGRESVVESVTSMNPSKVGDRSQYQHLLRLEDGADIMKGRTEWRPKNAGTNRAIST

SEQ ID NO: 185 - protein, 540 aa, Cuphea wrightii
MAAAASMVASPFCTWLVASCMSTSFDNDPRSPSVKRFPRRKRVLSQRGSTFQCLVASCIDPCDQYRSSASLSFLGDNGFASLFGSKPFMSNRGHRRLRRASHSGEAMAVALQPAQEAGTKKKPVIKQRRVVVTGMGVVTPLGHEPDVFYNNLLDGVSGISEIETFDCTQFPTRIAGEIKSFSTDGWVAPKLSKRMDKFMLYLLTAGKKALADGGITDEVMKELDKRKCGVLIGSGMGGMKVFNDAIEALRVSYKKMNPFCVPFATTNMGSAMLAMDLGWMGPNYSISTACATSNFCILNAANHIIRGEADMMLCGGSDAVIIPIGLGGFVACRALSQRNSDPTKASRPWDSNRDGFVMGEGAGVLLLEELEHAKKRGATIYAEFLGGSFTCDAYHMTEPHPEGAGVILCIEKALAQAGVSKEDVNYINAHATSTSAGDIKEYQALARCFGQNSELRVNSTKSMIGHLLGAAGGVEAVTVVQAIRTGWIHPNLNLEDPDKAVDAKLLVGPKKERLNVKVGLSNSFGFGGHNSSILFAPCNV

SEQ ID NO: 186 - protein, 534 aa, Cuphea hookeriana
MATASCMVASPFCTWLVAACMPTSSDNDPRSLSHKRLRLSRRRRTLSSHCSLRGSTFQCLDPCNQQRFLGDNGFASLFGSKPLRSNRGHLRLGRTSHSGEVMAVAMQPAQEVSTNKKPATKQRRVVVTGMGVVTPLGHDPDVYYNNLLDGISGISEIENFDCSQFPTRIAGEIKSFSTDGWVAPKFSERMDKFMLYMLTAGKKALADGGITEDAMKELNKRKCGVLIGSGLGGMKVFSDSIEALRTSYKKISPFCVPFSTTNMGSAILAMDLGWMGPNYSISTACATSNFCILNAANHIIKGEADMMLCGGSDAAVLPVGLGGFVACRALSQRNNDPTKASRPWDSNRDGFVMGEGAGVLLLEELEHAKKRGATIYAEFLGGSFTCDAYHMTEPHPEGAGVILCIEKALAQSGVSREDVNYINAHATSTPAGDIKEYQALAHCFGQNSELRVNSTKSMIGHLLGGAGGVEAVAVVQAIRTGWIHPNINLEDPDEGVDAKLLVGPKKEKLKVKVGLSNSFGFGGHNSSILFAPCN

SEQ ID NO: 187 - protein, 385 aa, Carthamus tinctorius
MLSKGAPAAPAVAAMYNASAKDTTFALTHSRSIGSVSIRRRYNVFLCNSSSSSRKVSPLLAVATGEQPSGVASLREADKEKSLGNRLRLGSLTEDGLSYKEKFVIRCYEVGINKTATIETIANLLQEVGGNHAQGVGFSTDGFATTTTMRKLHLIWVTARMHIEIYRYPAWSDVIEIETWVQGEGKVGTRRDWILKDYANGEVIGRATSKWVMMNEDTRRLQKVSDDVREEYLVFCPRTLRLAFPEENNNSMKKIPKLEDPAEYSRLGLVPRRSDLDMNKHVNNVTYIGWALESIPPEIIDTHELQAITLDYRRECQRDDIVDSLTSREPLGNAAGVKFKEINGSVSPKKDEQDLSRFMHLLRSAGSGLEINRCRTEWRKKPAKR

SEQ ID NO: 188 - protein, 584 aa, Arabidopsis thaliana
MTKEVCSNIGLWLLLTLLIGNYVVNLEASHHVYKRLTQSTNTKSPSVNQPYRTGFHFQPPKNWMNDPNGPMIYKGIYHLFYQWNPKGAVWGNIVWAHSTSTDLINWDPHPPAIFPSAPFDINGCWSGSATILPNGKPVILYTGIDPKNQQVQNIAEPKNLSDPYLREWKKSPLNPLMAPDAVNGINASSFRDPTTAWLGQDKKWRVIIGSKIHRRGLAITYTSKDFLKWEKSPEPLHYDDGSGMWECPDFFPVTRFGSNGVETSSFGEPNEILKHVLKISLDDTKHDYYTIGTYDRVKDKFVPDNGFKMDGTAPRYDYGKYYASKTFFDSAKNRRILWGWTNESSSVEDDVEKGWSGIQTIPRKIWLDRSGKQLIQWPVREVERLRTKQVKNLRNKVLKSGSRLEVYGVTAAQADVEVLFKVRDLEKADVIEPSWTDPQLICSKMNVSVKSGLGPFGLMVLASKNLEEYTSVYFRIFKARQNSNKYVVLMCSDQSRSSLKEDNDKTTYGAFVDINPHQPLSLRALIDHSVVESFGGKGRACITSRVYPKLAIGKSSHLFAFNYGYQSVDVLNLNAWSMNSAQIS

SEQ ID NO: 189 - DNA, 1274 bp, Cocosnucifer nucifera
actagtatggtggcctccgtggccgcctcctcctccttcttccccgtgccctcctcctcctcctccgcctccgccaaggcctcccgcggcatccccgacggcctggacgtgcgcggcatcgtggccaagcccgcctcctcctccggctggatgcaggccaaggcctccgcccgcgccatccccaagatcgacgacaccaaggtgggcctgcgcaccgacgtggaggaggacgccgcctccaccgcccgccgcacctcctacgggcgcgccaaccagctgcccgactggtccatgctgctggccgccatccgcaccatcttctccgccgccgagaagcagtggaccctgctggactccaagaagcgcggcgccgacgccgtggccgacgcctccggcgtgggcaagatggtgaagaacggcctggtgtaccgccagaacttctccatccgctcctacgagatcggcgtggacaagcgcgcctccgtggaggccctgatgaaccacttccaggagacctccctgaaccactgcaagtgcatcggcctgatgcacggcggcttcggctgcacccccgagatgacccgccgcaacctgatctgggtggtggccaagatgctggtgcacgtggagcgctacccctggtggggcgacgtggtgcagatcaacacctggatctcctcctccggcaagaacggcatgggccgcgactggcacgtgcacgactgccagaccggcctgcccatcatgcgcggcacctccgtgtgggtgatgatggacaagcacacccgccgcctgtccaagctgcccgaggaggtgcgcgccgagatcacccccttcttctccgagcgcgacgccgtgctggacgacaacggccgcaagctgcccaagttcgacgacgactccgccgcccacgtgcgccgcggcctgaccccccgctggcacgacttcgacgtgaaccagcacgtgaacaacgtgaagtacgtgggctggattctggagtccgtgcccgtgtggatgctggacggctacgaggtggccaccatgtccctggagtaccgccgcgagtgccgcatggactccgtggtgcagtccctgaccgccgtgtcctccgaccacgccgacggctcccccatcgtgtgccagcacctgctgcgcctggaggacggcaccgagatcgtgcgcggccagaccgagtggcgccccaagcagcaggcccgcgacctgggcaacatgggcctgcaccccaccgagtccaagtgattaattaactcgag

SEQ ID NO: 190 - protein, 640 aa, Aspergillus awamorii
MSFRSLLALSGLVCTGLANVISKRATLDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEEVNGSSFFTIAVQHRALVEGSAFATAVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 191 - protein, 604 aa, Rhizopus oryzae
MQLFNLPLKVSFFLVLSYFSLLVSAASIPSSASVQLDSYNYDGSTFSGKIYVKNIAYSKKVTVIYADGSDNWNNNGNTIAASYSAPISGSNYEYWTFSASINGIKEFYIKYEVSGKTYYDNNNSANYQVSTSKPTTTTATATTTTAPSTSTTTPPSRSEPATFPTGNSTISSWIKKQEGISRFAMLRNINPPGSATGFIAASLSTAGPDYYYAWTRDAALTSNVIVYEYNTTLSGNKTILNVLKDYVTFSVKTQSTSTVCNCLGEPKFNPDASGYTGAWGRPQNDGPAERATTFILFADSYLTQTKDASYVTGTLKPAIFKDLDYVVNVWSNGCFDLWEEVNGVHFYTLMVMRKGLLLGADFAKRNGDSTRASTYSSTASTIANKISSFWVSSNNWIQVSQSVTGGVSKKGLDVSTLLAANLGSVDDGFFTPGSEKILATAVAVEDSFASLYPINKNLPSYLGNSIGRYPEDTYNGNGNSQGNSWFLAVTGYAELYYRAIKEWIGNGGVTVSSISLPFFKKFDSSATSGKKYTVGTSDFNNLAQNIALAADRFLSTVQLHAHNNGSLAEEFDRTTGLSTGARDLTWSHASLITASYAKAGAPAA

SEQ ID NO: 192 - protein, 637 aa, Chlamydomonas reinhardtii
MQLFARSPAGVRVQQHAQRKSAKVAGRGRLNVRAEAIAMPPAPAEQEKELQRLEKGNAFEELKAMATSPRQSVNRPQKAEDLTFRQAPTIADCFPDSEKMYKEVKYDDEITLRVPFRRIHLTTGTDFDVYDTSGPQNVDPRVGLPKLRKPWVERREANGTHARAGVTQMALARAGIISEEMRFAAEREGLDPEFVRSELARGRAIIPANKCHLELEPCVIGRNFMTKVNSNFGNSAVTSSIEEEVEKLQWSTIWGADTVMDLSTGHNIFETREWVMRNSPVPVGTVPIYEALERADGQVEGITWELFRQVLLDQAEQGVDYWTIHAGVLLRHVPLTANRITGIVSRGGSIHAKLCLMEHKENFAYEHWDEILDICAKYDITLSIGDGLRPGCIADANDAAQFAELKTQGELTRRAWEKNVQVMNEGPGHVPLNKIPENMAKQLEWCSEAPFYTLGPLTTDIAPGYDHITSAIGAATIGALGTALLCYVTPKEHLGLPNRDDVKAGVIAYKIAAHAADLAKGHPAAASWDLELSKARFEFRWRDQFALSLDPVTAQAYHDATLPQEPAKTAHFCSMCGPKFCSMNITQELRQMVQAEQAQEAAAAAAAADDADLLAAAAEGMKEMSEKFKQSGAQLYH

SEQ ID NO: 193 - protein, 631 aa, Salmonella enterica
MSTTTLTRREQRAKAQHFIDTLEGTAFPNSKRIYVTGSQHDIRVPMREIQLSPTLIGGSKDNPQFEENEAVPVYDTSGPYGDPEVAINVQQGLAKLRQPWIDARNDSEELDDRSSAYTRERLADDGLDDLRFTGLLTPKRAKAGKRVTQLHYARKGIVTPEMEFIAIRENMGRERIRSEVLRHQHPGMNFGARLPENITPEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAEDLTWEAFRDTLLEQAEQGVDYFTIHAGVLLRYVPMTAKRLTGIVSRGGSIMAKWCLSHHKENFLFEHFREICEICAAYDVSLSLGDGLRPGSIQDANDEAQFSELHTLGELTKIAWEYDVQVMIEGPGHVPMHMIQRNMTEELESCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESGKVAHFCSMCGPKFCSMKISQEVRDYAAAQTIEIGMADMSEDFRAKGGEIYLKREEA

SEQ ID NO: 194 - protein, 264 aa, Unknown [sequence omitted]

SEQ ID NO: 195 - protein, 366 aa, Brassica napus
MLKLSCNVTNNLHTFSFFSDSSLFIPVNRRTIAVSSSQLRKPALDPLRAVISADQGSISPVNSCTPADRLRAGRLMEDGYSYKEKFIVRSYEVGINKTATVETIANLLQEVACNHVQKCGFSTDGFATTLTMRKLHLIWVTARMHIEIYKYPAWSDVVEIETWCQSEGRIGTRRDWILRDSATNEVIGRATSKWVMMNQDTRRLQRVTDEVRDEYLVFCPREPRLAFPEENNSSLKKIPKLEDPAQYSMLELKPRRADLDMNQHVNNVTYIGWVLESIPQEIIDTHELQVITLDYRRECQQDDIVDSLTTSEIPDDPISKFTGTNGSAMSSIQGHNESQFLHMLRLSENGQEINRGRTQWRKKSSR

SEQ ID NO: 196 - protein, 406 aa, Garcinia mangostana
MVATAATSSFFPLTSPSGDAKSGNPGKGSVSFGSMKSKSAASSRGLQVKANAQAPTKINGSTDDAQLPAPRTFINQLPDWSMLLAAITTVFLAAEKQWMMLDWKPRRPDMLIDTFGLGRIVQDGLVFRQNFSIRSYEIGADRTASIETVMNHLQETALNHVKTAGLLGDGFGSTPEMSKRNLIWVVTKMQVEVDRYPTWGDVVQVDTWVSASGKNGMRRDWLLRDGNTGETLTRASSVWVMMNKLTRRLSKIPEEVREEIGSYFVNSDPVVEEDGRKVTKLDDNTADFVRKGLTPKWNDLDINQHVNNVKYIGWILESAPQPILETRELSAVTLEYRRECGRDSVLRSLTAVSGGGVGDLGHAGNVECQHVLRLEDGAEIVRGRTEWRPKYINNFSIMGQIPTDAS

SEQ ID NO: 197 - protein, 415 aa, Cuphea hookeriana
MVAAAASSAFFPVPAPGASPKPGKFGNWPSSLSPSFKPKSIPNGGFQVKANDSAHPKANGSAVSLKSGSLNTQEDTSSSPPPRTFLHQLPDWSRLLTAITTVFVKSKRPDMHDRKSKRPDMLVDSFGLESTVQDGLVFRQSFSIRSYEIGTDRTASIETLMNHLQETSLNHCKSTGILLDGFGRTLEMCKRDLIWVVIKMQIKVNRYPAWGDTVEINTRFSRLGKIGMGRDWLISDCNTGEILVRATSAYAMMNQKTRRLSKLPYEVHQEIVPLFVDSPVIEDSDLKVHKFKVKTGDSIQKGLTPGWNDLDVNQHVSNVKYIGWILESMPTEVLETQELCSLALEYRRECGRDSVLESVTAMDPSKVGVRSQYQHLLRLEDGTAIVNGATEWRPKNAGANGAISTGKTSNGNSVS

SEQ ID NO: 198 - protein, 371 aa, Ricinus communis
MLKVPCCNATDPIQSLSSQCRFLTHFNNRPYFTRRPSIPTFFSSKNSSASLQAVVSDISSVESAACDSLANRLRLGKLTEDGFSYKEKFIVRSYEVGINKTATVETIANLLQEVGCNHAQSVGFSTDGFATTTSMRKMHLIWVTARMHIEIYKYPAWSDVVEVETWCQSEGRIGTRRDWILTDYATGQIIGRATSKWVMMNQDTRRLQKVTDDVREEYLVFCPRELRLAFPEENNRSSKKISKLEDPAQYSKLGLVPRRADLDMNQHVNNVTYIGWVLESIPQEIIDTHELQTITLDYRRECQHDDIVDSLTSVEPSENLEAVSELRGTNGSATTTAGDEDCRNFLHLLRLSGDGLEINRGRTEWRKKSAR

SEQ ID NO: 199 - protein, 412 aa, Ricinus communis
FRQITKNQKKKVRKKTMALKLNPFLSQTQKLPSFALPPMASTRSPKFYMASTLKSGSKEVENLKKPFMPPREVHVQVTHSMPPQKIEIFKSLDNWAEENILVHLKPVEKCWQPQDFLPDPASDGFDEQVRELRERAKEIPDDYFVVLVGDMITEEALPTYQTMLNTLDGVRDETGASPTSWAIWTRAWTAEENRHGDLLNKYLYLSGRVDMRQIEKTIQYLIGSGMDPRTENSPYLGFIYTSFQERATFISHGNTARQAKEHGDIKLAQICGTIAADEKRHETAYTKIVEKLFEIDPDGTVLAFADMMRKKISMPAHLMYDGRDDNLFDHFSAVAQRLGVYTAKDYADILEFLVGRWKVDKLTGLSAEGQKAQDYVCRLPPRIRRLEERAQGRAKEAPTMPFSWIFDRQVKL

SEQ ID NO: 200 - protein, 390 aa, Olea europaea
MALKLCFPPHKMPSFPDARIRSHRVFMASTIHSPSMEVGKVKKPFTPPREVHVQVTHSLAPEKREIFNSLNNWAQENILVLLKDVDKCWQPSDFLPDSASEGFDEQVMELRKRCKEIPDDYFIVLVGDMITEEALPTYQTMLNTLDGVRDETGASLTPWAIWTRAWTAEENRHGDLLNKYLYLSGRVDMKQIEKTIQYLIGSGMDPRTENNPYLGFIYTSFQERATFISHGNTARLAKEHGDLKLAQICGIIAADEKRHETAYTKIVEKLFEIDPDGTVLALADMMRKKVSMPAHLMYDGQDDNLFENFSSVAQRLGVYTAKDYADILEFLVGRWDIEKLTGLSGEGRKAQDYVCTLPPRIRRLEERAQSRVKKASATPFSWIFGREINL

SEQ ID NO: 201 - protein, 415 aa, Cuphea hookeriana
MVATAASSAFFPLPSADTSSRPGKLGNKPSSLSPLKPKSTPNGGLQVKANASAPPKINGSPVGLKSGGLKTQEDAHSAPPPRTFINQLPDWSMLLAAITTVFLAAEKQWMMLDWKPKRPDMLVDPFGLGSIVQDGLVFRQNFSIRSYEIGADRTASIETVMNHLQETALNHVKIAGLSNDGFGRTPEMYKRDLIWVVAKMQVMVNRYPTWGDTVEVNTWVAKSGKNGMRRDWLISDCNTGEILTRASSVWVMMNQKTRRLSKIPDEVRNEIEPHFVDSPPVIEDDDRKLPKLDEKTADSIRKGLTPRWNDLDVNQHVNNVKYIGWILESTPPEVLETQELCSLTLEYRRECGRESVLESLTAMDPSGGGYGSQFQHLLRLEDGGEIVKGRTEWRPKNGVINGVVPTGESSPGDYS

SEQ ID NO: 202 - protein, 414 aa, Cuphea hookeriana
MVATAASSAFFPVSSPVTSSRPGKPGNGSSSFSPIKPKFVANGGLQVKANASAPPKINGSSVGLKSCSLKTQEDTPSAPAPRTFINQLPDWSMLLAAITTVFLAAEKQWMMLDWKPKRPDMLVDPFGLGSIVQHGLVFRQNFSIRSYEIGADRTASIETVMNHLQETALNHVKSAGLMNDGFGRTPEMYKKDLIWVVAKMQVMVNRYPTWGDTVEVNTWVAKSGKNGMRRDWLISDCNTGEILTRASSVWVMMNQKTRRLSKIPDEVRHEIEPHFVDSPPVIEDDDRKLPKLDDKTADSIRKGLTPKWNDLDVNQHVNNVKYIGWILESTPQEVLETQELCSLTLEYRRECGRESVLESLTAADPSGKGFGSQFQHLLRLEDGGEIVKGRTEWRPKTAGINGAIPSGETSPGDS

SEQ ID NO: 203 - protein, 383 aa, Umbellularia californica
MVTTSLASAFFSMKAVMLAPDGSGIKPRSSGLQVRAGKEQNSCKMINGTKVKDTEGLKGRSTLHGWSMPLELITTIFSAAEKQWTNLVSKPPQLLDDHLGLHGLVFRRTFAIRCSEVGPDRSTSIVAVMNYLQEAACNHAESLGLLGDGFGETLEMSRRDLIWVVRRTHVVVERYPAWGDTVEVEAWIGAAGNIGMRRHFLVRDCKTGHILARCTSVSVMMNMRTRRLSKIPQEVRGEIDPLFIEKFAVKEGEIKKLQKFNDSTADYIQGGWTPRWNDLDVNQHVNNIKYVGWIFKSVPDSIYENHHLSSITLEYRRECTRGRALQSLTTVCGGSSEAGIICEHLLQLEDGSEVLRGRTDWRPKRTDSFEGISERFPQQEPHN

SEQ ID NO: 204 - protein, 417 aa, Elaeis guineensis
MVASIAASAFFPTPSFSPTASAKASKTIGEGSENLDARGIIAKPTSSSAAMQGKVMAQAVSKINGAKVGLKAESQKAEEDAAPSSAPRTFYNQLPDWSVLLAAVTTIFLAAEKQWTLLDWKPRRPDMLTDAFSLGKIVQDGLVFKQNFSIRSYEIGADRTASIETLMNHLQETALNHVRSAGLMGDGFGATPEMSKRNLIWVVTKVRVLIEHYPSWGDVVEVDTWVGPAGKNGMRRDWHVRDHRTGQTILRATRVWVMMNKNTRKLSKVPEEVRAEIGPYFVERAAIVDEDSRKLPKLDEDTTDYVKKGLTPRWSDLDVNQHVNNVKYIGWILESAPISILENHELASMTLEYRRECGRDSVLQSLTAVANDCTGGLPEASIECQHLLQLECGAEIVRGRTQWRPRRASGPTSAGSA

SEQ ID NO: 205 - protein, 417 aa, Elaeis guineensis
MVASIVAWAFFPTPSFSPTASAKASKTIGEGSENLNVRGIIAKPTSSSAAKQGKVMAQAVPKINGAKVGLKAESQKAEEDAAPSSAPRTFYNQLPDWSVLLAAVTTIFLAAEKQWTLLDWKPRRPDMLTGAFSLGKIVQDGLVFRQNFSIRSYEIGADRTASIETLMNHLQETALNHVRNAGLLGDGFGATPEMSKRNLIWVVTKMQVLIEHYPSWGDVVEVDTWVGASGKNGMRRDWHVRDYRTGQTILRATSIWVMMDKHTRKLSKMPEEVRAEIGPYFMEHAAIVDEDSRKLPKLDDDTADYIKWGLTPRWSDLDVNQHVNNVKYIGWILESAPISILENHELASMTLEYRRECGRDSVLQSLTAVANDCTGGLPEASIECQHLLQLECGAEIVRGRTQWRPRRASGPTSAGSA

SEQ ID NO: 206 - protein, 333 aa, Elaeis guineensis
FYNQLPDWSVLLAAVTTIFLAAEKQWTLLDWKPRRPDMLADAFGLGKIVQDGLVFKQNFSIRSYEIGADRTASIETLMNHLQETALNHVRSAGLMGDGFGATPEMSKRNLIWVVTKMRVLIKHYPSWGDVVEVDTWVGPTGKNGMRRDWHVRDHRTGQTILRATSVWVMMNKNTRKLSKVPEEVRAELGPYFVERAAIVDEDSRKLPKLDEDTTDYIKKGLTPRWSDLDVNQHVNNVKYIGWILESAPISFLENHELASMSLEYRRECGRDSVLQSLTAVSNDLTDGLPEAGIECQHLLQLECGTELVKGRTEWRPKHSLALRNMGPTPGGSA

SEQ ID NO: 207 - protein, 421 aa, Populus tomentosa
MVATAATSSFFPVPSPPGDAKSSKVGSGSASLGGIKSKSASSGALQVKANAQAPPKINGSPVGLTASVETAKKEDVVSSPAPRTFINQLPDWSMLLAAITTMFLAAEKQWMMLDWKPKRADMLIDPFGIGRIVQDGLVFSQNFSIRSYEIGADRTASIETLMNHLQETALNHVKTAGLLGDGFGSTPEMSKRNLIWVVTRMQILVDRYPTWGDVVHVDTWVSASGKNGMRRDWLVRDAKTGETLTRASSLWVMMNKVTRRLSKIPEDVRGEIEPYFLNSDPVVNEDSTKLPKLDDKTADYIRKGLTPRWNDLDVNQHVNNVKYIGWILESAPPPILESHELAAITLEYRRECGRDSVLQSLTAVSGAGIGNLGGPGKVECQHLLRHEDGAEIVRGRTEWRPKHANNFGMMGGQMPADESGA

SEQ ID NO: 208 - protein, 412 aa, Arabidopsis thaliana
MVATSATSSFFPVPSSSLDPNGKGNKIGSTNLAGLNSAPNSGRMKVKPNAQAPPKINGKKVGLPGSVDIVRTDTETSSHPAPRTFINQLPDWSMLLAAITTIFLAAEKQWMMLDWKPRRSDMLVDPFGIGRIVQDGLVFRQNFSIRSYEIGADRSASIETVMNHLQETALNHVKTAGLLGDGFGSTPEMFKKNLIWVVTRMQVVVDKYPTWGDVVEVDTWVSQSGKNGMRRDWLVRDCNTGETLTRASSVWVMMNKLTRRLSKIPEEVRGEIEPYFVNSDPVLAEDSRKLTKIDDKTADYVRSGLTPRWSDLDVNQHVNNVKYIGWILESAPVGIMERQKLKSMTLEYRRECGRDSVLQSLTAVTGCDIGNLATAGDVECQHLLRLQDGAEVVRGRTEWSSKTPTTTWGTAP

SEQ ID NO: 209 - protein, 412 aa, Arabidopsis thaliana
MVATSATSSFFPVPSSSLDPNGKGNKIGSTNLAGLNSAPNSGRMKVKPNAQAPPKINGKRVGLPGSVDIVRTDTETSSHPAPRTFINQLPDWSMLLAAITTIFLAAEKQWMMLDWKPRRSDMLVDPFGIGRIVQDGLVFRQNFSIRSYEIGADRSASIETVMNHLQETALNHVKTAGLLGDGFGSTPEMFKKNLIWVVTRMQVVVDKYPTWGDVVEVDTWVSQSGKNGMRRDWLVRDCNTGETLTRASSVWVMMNKLTRRLSKIPEEVRGEIEPYFVNSDPVLAEDSRKLTKIDDKTADYVRSGLTPRWSDLDVNQHVNNVKYIGWILESAPVGIMERQKLKSMTLEYRRECGRDSVLQSLTAVTGCDIGNLATAGDVECQHLLRLQDGAEVVRGRTEWSSKTPTTTWGTAP

SEQ ID NO: 210 - protein, 412 aa, Arabidopsis thaliana
MVATSATSSFFPVPSSSLDPNGKGNKIGSTNLAGLNSTPNSGRMKVKPNAQAPPKINGKRVGLPGSVDIVRTDTETSSHPAPRTFINQLPDWSMLLAAITTIFLAAEKQWMMLDWKPRRSDMLVDPFGIGRIVQDGLVFRQNFSIRSYEIGADRSASIETVMNHLQETALNHVKTAGLLGDGFGSTPEMFKKNLIWVVTRMQVVVDKYPTWGDVVEVDTWVSQSGKNGMRRDWLVRDCNTGETLTRASSVWVMMNKLTRRLSKIPEEVRGEIEPYFVNSDPVLAEDSRKLTKIDDKTADYVRSGLTPRWSDLDVNQHVNNVKYIGWILESAPVGIMERQKLKSMTLEYRRECGRDSVLQSLTAVTGCDIGNLATAGDVECQHLLRLQDGAEVVRGRTEWSSKTPTTTWGTAP

SEQ ID NO: 211 - protein, 413 aa, Gossypium hirsutum
MVATAVTSAFFPVTSSPDSSDSKNKKLGSIKSKPSVSSGSLQVKANAQAPPKINGTVASTTPVEGSKNDDGASSPPPRTFINQLPDWSMLLAAITTIFLAAEKQWMMLDWKPRRPDMVIDPFGIGKIVQDGLVFSQNFSIRSYEIGADQTASIETLMNHLQETAINHCRSAGLLGEGFGATPEMCKKNLIWVVTRMQVVVDRYPTWGDVVQVDTWVSASGKNGMRRDWLVSNSETGEILTRATSVWVMMNKLTRRLSKIPEEVRGEIEPFFMNSDPVLAEDSQKLVKLDDSTAEHVCKGLTPKWSDLDVNQHVNNVKYIGWILESAPLPILESHELSALTLEYRRECGRDSVLQSLTTVSDSNTENAVNVGEFNCQHLLRLDDGAEIVRGRTRWRPKHAKSSANMDQITAKRA

SEQ ID NO: 212 - protein, 414 aa, Cuphea lanceolata
MVATAASSAFFPLPSPDTSSRPGKLGNGSSSLSPLKPKFVANAGLKVKASASAPPKINGSSVGLKSGSLKTQEDTPSVPPPRTFINQLPDWSMLLAAITTVFLAAEKQWMMLDWKPKRPDMLVDPFGLGSIVQGGLVFRQNFSIRSYEIGADRTASIETVMNHLQETALNHVKSAGLLNDGFGRTPEMFKRDLIWVVAKMQVMVNRYPTWGDTVEVNTWVAKSGKNGMRRDWLISDCNTGEILTRASSVWVMMNQKTRKLSKIPDEVRHEIEPHFIDCAPVIEDDDRKLRKLDEKTADSIRKGLTPKWNDLDVNQHVNNVKYIGWILESTPQEVLETQELSSLTLEYRRECGRESVLESLTAVDSSGKGFGSQFQHLLRLEDGGEIVKGRTEWRPKTAGVNGAIASGETSHGDS

SEQ ID NO: 213 - protein, 414 aa, Cuphea calophylla
MVATAASSAFFPVPSPDTSSRPGKLGNGSSSLSPLKPKLMANGGLQVKANASAPPKINGSSVGLKSGSLKTQEDTPSAPPPRTFINQLPDWSMLLAAITTVFLAAEKQWMMLDWKPKRPDMLVDPFGLGRIVQDGLVFRQNFSIRSYEIGADRTASIETVMNHLQETALNHVKSAGLLNDGFGRTPEMYKRDLIWVVAKMQVMVNRYPTWGDTVEVNTWVAKSGKNGMRRDWLISDCNTGEILTRASSVWVMMNQKTRRLSKIPDEVRHEIEPHFVDSAPVIEDDDRKLPKLDEKTADSIRKGLTPKWNDLDVNQHVNNVKYIGWILESTPPEVLETQELCSLTLEYRRECGRESVLESLTAVDPSGKGSGSQFQHLLRLEDGGEIVKGRTEWRPKTAGINGPIASGETSPGDS

SEQ ID NO: 214 - protein, 410 aa, Gossypium hirsutum
TAVTSAFFPVTSSPDSSDSKNKKLGSIKSKPSVSSGSLQVKANAQAPPKINGTVASTTPVEGSKNDDGASSPPPRTFINQLPDWSMLLAAITTIFLAAEKQWMMLDWKPRRPDMVIDPFGIGKIVQDGLVFSQNFSIRSYEIGADQTASIETLMNHLQETAINHCRSAGLLGEGFGATPEMCKKNLIWVVTRMQVVVDRYPTWGDVVQVDTWVSASGKNGMRRDWLVSNSETGEILTRATSVWVMMNKLTRRLSKIPEEVRGEIEPFFMNSDPVLAEDSQKLVKLDDSTAEHVCKGLTPKWSDLDVNQHVNNVKYIGWILESAPLPILESHELSALTLEYRRECGRDSVLQSLTTVSDSNTENAVNVGEFNCQHLLRLDDGAEIVRGRTRWRPKHAKSSANMDQITAKRA

SEQ ID NO: 215 - protein, 400 aa, Vitis vinifera
  misc_feature (30)..(30): Xaa can be any naturally occurring amino acid
MVATAATSAFFAVASPSSDPDAKPSTKPGXGSAILRGIKSRNAPSGSLQVKANAQAPPKINGTTVGYTSSAEGVKIEDDMSSPPPRTFINQLPDWSMLLAAITTIFLAAEKQWMMLDWKPRRSDMLIDPFGLGKIVQDGLVFRQNFSIRSYEIGADRTASIETLMNHLQETALNHVRTAGLLGDGFGSTPEMSIRNLIWVVTRMQVVVDRYPTWGDVVQVDTWVCASGKNGMRRDWIIRDCKTGETLTRASSVWVMMNKQTRRLSKIPDAVRAEIEPYFMDSAPIVDEDGRKLPKLDDSTADYIRTGLTPRWSDLDVNQHVNNVKYIGWILESAPLPILESHELSSMTLEYRRECGRDSVLQSLTAVSGTGVGNLLDCGNVECQHLLRLEEGAEIVEGKD

SEQ ID NO: 216 - protein, 411 aa, Brassica juncea
  misc_feature (22)..(22): Xaa can be any naturally occurring amino acid
  misc_feature (171)..(171): Xaa can be any naturally occurring amino acid
  misc_feature (192)..(192): Xaa can be any naturally occurring amino acid
MVATSATSLFFPLPSSSLDPNXKTNNRVTSTNFAGLGPTPNSGGRMKVKPNAQAPPKINGKKVGLPGSVEIETSQQQQPAPRTFINQLPDWSMLLAAITTVFLAAEKQWMMLDWKPRRSDMIMEPFGLGRIVQDGLVFRQNFSIRSYEIGADRSASIETVMNHLQETALNXVKTAGLLGDGFGSTPEMVKKXLIWVVTRMQVVVDTYPTWGDVVEVDTWVSKSGKNGMRRDWLVRDGNTGQILTRASSVWVMMNKLTRRLSKIPEEVRGEIEPYFVDFDPVLAEDSRKLTKLDDKTADYVRSGLTPRWSDLDVNQHVNNVKYIGWILESAPVGMMESQKLKSMTLEYRRECGRDSVLQSLTAVSGCDIGNLGTAGEVECQHLLRLQDGAEVVRGRTEWSSKTPTTTWDITP

SEQ ID NO: 217 - protein, 333 aa, Madhuca longifolia
INQLPDWSMLLAAITTIFLAAEKQWMMLDWKPKRPDMLIDPFGLGKIVQDGLVFRQNFSIRSYEIGADRTASIETLMNHLQETALNHVKTAGLLGDGFGVTPEMCKKNLIWVVAKMQVLVDRYPTWGDVVQVDTWVAASGKNGMRRDWLVRDFETGDILTKASSVWVMMNRETRRLSKIPDEVRLEIGSYFVDSPPVLDEDGRKLPKLDESTADHIRTGLTPRWNDLDVNQHVNNVKYIGWILESAPQPILENHELASMTLEYRRECGKDSVLQSLTGVTSGGVGGLADSGHVECQHLLRLEGGAEIVKGRTEWRPKYANRLGCLDQLPAGST

SEQ ID NO: 218 - protein, 425 aa, Oryza sativa
MAGSLAASAFFPGPGSSPAASARSSKSAAVTGELPENLSVRGIVAKPNPPPAAMQVKAQAQTLPKVNGTKVNLKTVKPDMEETVPYSAPKTFYNQLPDWSMLLAAITTIFLAAEKQWTLLDWKPKKPDMLVDTFGFGRIIQDGMVFRQNFMIRSYEIGADRTASIETLMNHLQETALNHVRTAGLLGDGFGATPEMSKRNLIWVVSKIQLLVEQYPAWGDTVQVDTWVAAAGKNGMRRDWHVRDYNSGRTILRATSVWVMMHKKTRRLSKMPDEVRAEIGPYFNDRSAITEEQSEKLAKTGNKVGDDATEQFIRKGLTPRWGDLDVNQHVNNVKYIGWILESAPISVLEKHELASMTLDYRKECGRDSVLQSLTTVSGECTSIGADKQASAIQCDHLLQLESGADIVKAHTEWRPKRSHAAAENA

SEQ ID NO: 219 - protein, 425 aa, Oryza sativa
MAGSLAASAFFPGPGSSPAASARSSKNAAVTGELPENLSVRGIVAKPNPPPAAMQVKAQAQTLPKVNGTKVNLKTVKPDMEETVPYSAPKTFYNQLPDWSMLLAAITTIFLAAEKQWTLLDWKPKKPDMLVDTFGFGRIIQDGMVFRQNFMIRSYEIGADRTASIETLMNHLQETALNHVRTAGLLGDGFGATPEMSKRNLIWVVSKIQLLVEQYPAWGDTVQVDTWVAAAGKNGMRRDWHVRDYNSGRTILRATSVWVMMHKKTRRLSKMPDEVRAEIGPYFNDRSAITEEQSEKLAKTGNKVGDDATEQFIRKGLTPRWGDLDVNQHVNNVKYIGWILESAPISVLEKHELASMTLDYRKECGRDSVLQSLTTVSGECTSIGADKQASAIQCDHLLQLESGADIVKAHTEWRPKRSHAAAENA

SEQ ID NO: 220 - protein, 427 aa, Oryza sativa
MAGSLAASAFFPVPGSSPAASARSSKNTTGELPENLSVRGIVAKPNPSPGAMQVKAQAQALPKVNGTKVNLKTTSPDKEDIIPYTAPKTFYNQLPDWSMLLAAVTTIFLAAEKQWTLLDWKPKKPDMLADTFGFGRIIQDGLVFRQNFLIRSYEIGADRTASIETLMNHLQETALNHVKTAGLLGDGFGATPEMSKRNLIWVVSKIQLLVERYPSWGDMVQVDTWVAAAGKNGMRRDWHVRDYNSGQTILRATSVWVMMNKNTRRLSKMPDEVRAEIGPYFNGRSAISEEQGEKLPKPGTTFDGAATKQFTRKGLTPKWSDLDVNQHVNNVKYIGWILESAPISILEKHELASMTLDYRKECGRDSVLQSLTTVSGECDDGNTESSIQCDHLLQLESGADIVKAHTEWRPKRAQGEGNMGFFPAESA

SEQ ID NO: 221 - protein, 419 aa, Cuphea lanceolata
MVAAAATSAFFPVPAPGTSPKPGKSGNWPSSLSPTFKPKSIPNAGFQVKANASAHPKANGSAVNLKSGSLNTQEDTSSSPPPRAFLNQLPDWSMLLTAITTVFVAAEKQWTMLDRKSKRPDMLVDSVGLKSIVRDGLVSRQSFLIRSYEIGADRTASIETLMNHLQETSINHCKSLGLLNDGFGRTPGMCKNDLIWVLTKMQIMVNRYPTWGDTVEINTWFSQSGKIGMASDWLISDCNTGEILIRATSVWAMMNQKTRRFSRLPYEVRQELTPHFVDSPHVIEDNDQKLHKFDVKTGDSIRKGLTPRWNDLDVNQHVSNVKYIGWILESMPIEVLETQELCSLTVEYRRECGMDSVLESVTAVDPSENGGRSQYKHLLRLEDGTDIVKSRTEWRPKNAGTNGAISTSTAKTSNGNSAS

SEQ ID NO: 222 - protein, 362 aa, Myristica fragrans
PDWSMLLAAITTIFLAAEKQWTNLDWKPRRPDMLVDFDPFSLGRFVQDGLIFRQNFSIRSYEIGADRTASIETLMNHLQETALNHVRCIGLLDDGFGSTPEMTRRDLIWVVTRMQVLVDRYPSWGDVIEVDSWVTPSGKNGMKREWFLRDCKTGEILTRATSVWVMMNKRTRRLSKIPEEVRVEIEPYFVEHGVLDEDSRKLPKLNDNTANYIRRGLAPRWSDLDVNQHVNNVKYIGWILESVPSSLLESHELYGMTLEYRKECGKDGLLQSLTAVASDYGGGSLEAGVECDHLLRLEDGSEIMRGKTEWRPKRAANTTYFGSVDDIPPHPIYIYIYIYIYIYIYWVGSSCSGSSTTMSRTR

SEQ ID NO: 223 - protein, 382 aa, Cinnamomum camphora
MATTSLASAFCSMKAVMLARDGRGMKPRSSDLQLRAGNAQTSLKMINGTKFSYTESLKKLPDWSMLFAVITTIFSAAEKQWTNLEWKPKPNPPQLLDDHFGPHGLVFRRTFAIRSYEVGPDRSTSIVAVMNHLQEAALNHAKSVGILGDGFGTTLEMSKRDLIWVVKRTHVAVERYPAWGDTVEVECWVGASGNNGRRHDFLVRDCKTGEILTRCTSLSVMMNTRTRRLSKIPEEVRGEIGPAFIDNVAVKDEEIKKPQKLNDSTADYIQGGLTPRWNDLDINQHVNNIKYVDWILETVPDSIFESHHISSFTIEYRRECTMDSVLQSLTTVSGGSSEAGLVCEHLLQLEGGSEVLRAKTEWRPKLTDSFRGISVIPAESSV

SEQ ID NO: 224 - protein, 429 aa, Myristica fragrans
MVATSAASAFFPVASPSPVKPSMMLGGGGGSDNLDARGIKSRPASSGGLQVKANAHTVPKINGNKAGLLTPMESTKDEDIVAAPTVAPKRTFINQLPDWSMLLAAITTIFLAAEKQWTNLDWKPRRPDMLVDFDPFSLGRFVQDGLIFRQNFSIRSYEIGADRTASIETLMNHLQETALNHVRCIGLLDDGFGSTPEMTRRDLIWVVTRMQVLVDRYPSWGDVIEVDSWVTPSGKNGMKREWFLRDCKTGEILTRATSVWVMMNKRTRRLSKIPEEVRVEIEPYFVEHGVLDEDSRKLPKLNDNTANYIRRGLAPRWSDLDVNQHVNNVKYIGWILESVPSSLLESHELYGMTLEYRKECGKDGLLQSLTAVASDYGGGSLEAGVECDHLLRLEDGSEIMRGKTEWRPKRAANTTYFGSVDDIPPANNA

SEQ ID NO: 225 - DNA, 8672 bp, Artificial Sequence
  synthetic polynucleotide
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgccacccaggaggacgcccactccgccccccccccccgcaccttcatcaaccagctgcccgactggtccatgctgctggccgccatcaccaccgtgttcctggccgccgagaagcagtggatgatgctggactggaagcccaagcgccccgacatgctggtggaccccttcggcctgggctccatcgtgcaggacggcctggtgttccgccagaacttctccatccgctcctacgagatcggcgccgaccgcaccgcctccatcgagaccgtgatgaaccacctgcaggagaccgccctgaaccacgtgaagatcgccggcctgtccaacgacggcttcggccgcacccccgagatgtacaagcgcgacctgatctgggtggtggccaagatgcaggtgatggtgaaccgctaccccacctggggcgacaccgtggaggtgaacacctgggtggccaagtccggcaagaacggcatgcgccgcgactggctgatctccgactgcaacaccggcgagatcctgacccgcgcctcctccgtgtgggtgatgatgaaccagaagacccgccgcctgtccaagatccccgacgaggtgcgcaacgagatcgagccccacttcgtggactccccccccgtgatcgaggacgacgaccgcaagctgcccaagctggacgagaagaccgccgactccatccgcaagggcctgaccccccgctggaacgacctggacgtgaaccagcacgtgaacaacgtgaagtacatcggctggatcctggagtccaccccccccgaggtgctggagacccaggagctgtgctccctgaccctggagtaccgccgcgagtgcggccgcgagtccgtgctggagtccctgaccgccatggacccctccggcggcggctacggctcccagttccagcacctgctgcgcctggaggacggcggcgagatcgtgaagggccgcaccgagtggcgccccaagaacggcgtgatcaacggcgtggtgcccaccggcgagtcctcccccggcgactactccatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 226 - DNA, 9525 bp, artificial sequence
  synthetic polynucleotide
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggtggccaccgccgcctcctccgccttcttccccctgccctccgccgacacctcctcccgccccggcaagctgggcaacaagccctcctccctgtcccccctgaagcccaagtccacccccaacggcggcctgcaggtgaaggccaacgcctccgccccccccaagatcaacggctcccccgtgggcctgaagtccggcggcctgaaggggcgcgccacccaggaggacgcccactccgccccccccccccgcaccttcatcaaccagctgcccgactggtccatgctgctggccgccatcaccaccgtgttcctggccgccgagaagcagtggatgatgctggactggaagcccaagcgccccgacatgctggtggaccccttcggcctgggctccatcgtgcaggacggcctggtgttccgccagaacttctccatccgctcctacgagatcggcgccgaccgcaccgcctccatcgagaccgtgatgaaccacctgcaggagaccgccctgaaccacgtgaagatcgccggcctgtccaacgacggcttcggccgcacccccgagatgtacaagcgcgacctgatctgggtggtggccaagatgcaggtgatggtgaaccgctaccccacctggggcgacaccgtggaggtgaacacctgggtggccaagtccggcaagaacggcatgcgccgcgactggctgatctccgactgcaacaccggcgagatcctgacccgcgcctcctccgtgtgggtgatgatgaaccagaagacccgccgcctgtccaagatccccgacgaggtgcgcaacgagatcgagccccacttcgtggactccccccccgtgatcgaggacgacgaccgcaagctgcccaagctggacgagaagaccgccgactccatccgcaagggcctgaccccccgctggaacgacctggacgtgaaccagcacgtgaacaacgtgaagtacatcggctggatcctggagtccaccccccccgaggtgctggagacccaggagctgtgctccctgaccctggagtaccgccgcgagtgcggccgcgagtccgtgctggagtccctgaccgccatggacccctccggcggcggctacggctcccagttccagcacctgctgcgcctggaggacggcggcgagatcgtgaagggccgcaccgagtggcgccccaagaacggcgtgatcaacggcgtggtgcccaccggcgagtcctcccccggcgactactccatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcg

SEQ ID NO: 227 - DNA, 9313 bp, artificial sequence
  synthetic polynucleotide
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgcccagctgcccgactggagcatgctgctggccgcgatcaccaccctgttcctggcggccgagaagcagtggatgatgctggactggaagcccaagcgccccgacatgctggtggaccccttcggcctgggccgcttcgtgcaggacggcctggtgttccgcaacaacttcagcatccgcagctacgagatcggcgcggaccgcaccgccagcatcgagaccctgatgaaccacctgcaggagaccgccctgaaccacgtgaagagcgtgggcctgctggaggacggcctgggcagcacccgcgagatgagcctgcgcaacctgatctgggtggtgaccaagatgcaggtggcggtggaccgctaccccacctggggcgacgaggtgcaggtgagcagctgggcgaccgccatcggcaagaacggcatgcgccgcgagtggatcgtgaccgacttccgcaccggcgagaccctgctgcgcgccaccagcgtgtgggtgatgatgaacaagctgacccgccgcatcagcaagatccccgaggaggtgtggcacgagatcggccccagcttcatcgacgcgccccccctgcccaccgtggaggacgacggccgcaagctgacccgcttcgacgagagcagcgccgacttcatccgcaagggcctgaccccccgctggagcgacctggacatcaaccagcacgtgaacaacgtgaagtacatcggctggctgctggagagcgcgccccccgagatccacgagagccacgagatcgccagcctgaccctggagtaccgccgcgagtgcggccgcgacagcgtgctgaacagcgccaccaaggtgagcgacagcagccagctgggcaagagcgccgtggagtgcaaccacctggtgcgcctgcagaacggcggcgagatcgtgaagggccgcaccgtgtggcgccccaagcgccccctgtacaacgacggcgccgtggtggacgtgcccgccaagaccagcgatgacgatgacaagctgggatgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 228 - DNA, 8522 bp, artificial sequence
  synthetic polynucleotide
ctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtgcgtattgggcgctcttccgctcccgtgatcacacaggtgccttgcgagcgtgatcacactattttgggggtcctacagtactgaaatggtgagaagtcgtactgaaatcaaggatgaacaatgaaaatggtgctgtggtggcttctcaaaggtcaagaatcagtcgctcgcgtcaggaaatcgcggcgtcaaccagcgtgggcgcggtcagtggccccgcactggtcaccatagcctctcctgccacagtagcgatcccctgggcgttcactctcagcagcggctgtactgcctcccagattttcttcttctggacctgcgggcgtgagaggatgagcagggtggggccaagggctcaatcctgaacggccctcattcggtttccaatcccacaacacatacccacagcaggtcagaccacgcattcgcaccatgcgcaccaataacgtgtccttacctgattgggtgtggcaggctccgtggacaggagtgcctcgtcccccgcccagacccgctcccccgtcacggcggcgtccgggacccgcagcggctccaccgcggtgtgatccgcgttggcggcgcagagcagcatcccagccgatttgaccccgcgcatgctccgaggcttgaggttggccagcaccaccacccgccggccgacaaggtcctccagggtcacgtgccggaccaggccactcacgatggtgcgagggcccccctcctcgccgaggtcgatctgctcgacgtacagactgcgacatgcgtggcgagtggtcatcagaaggaagcaggtgtgcagaaggggcacgtggttggtattgagagtagccaaagctttgtgccaatcagaaagtcaacgcagctgcctgcctggctcgcgtacggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcgtacccatcagcatccgggtgaatcttggcctccaagatatggccaatcctcacatccagcttggcaaaatcgactagactgtctgcaagtgggaatgtggagcacaaggttgcttgtagcgatcgacagactggtggggtacattgacaggtgggcagcgccgcatccatcgtgcctgacgcgagcgccgccggttgctcgcccgtgcctgccgtcaaagagcggcagagaaatcgggaaccgaaaacgtcacattgcctgatgttgttacatgctggactagactttcttggcgtgggtctgctcctcgccaggtgcgcgacgcctcggggctgggtgcgagggagccgtgcggccacgcatttgacaagacccaaagctcgcatctcagacggtcaaccgttcgtattatacattcaacatatggtacatacgcaaaaagcatgccaacgatgacagctcttcgcccacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 229 - DNA, 9426 bp, artificial sequence
  synthetic polynucleotide
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggtggtggccgccgccgccagcagcgccttcttccccgtgcccgccccccgccccacccccaagcccggcaagttcggcaactggcccagcagcctgagccagcccttcaagcccaagagcaaccccaacggccgcttccaggtgaaggccaacgtgagcccccacgggcgcgcccccaaggccaacggcagcgccgtgagcctgaagtccggcagcctgaacaccctggaggacccccccagcagcccccccccccgcaccttcctgaaccagctgcccgactggagccgcctgcgcaccgccatcaccaccgtgttcgtggccgccgagaagcagttcacccgcctggaccgcaagagcaagcgccccgacatgctggtggactggttcggcagcgagaccatcgtgcaggacggcctggtgttccgcgagcgcttcagcatccgcagctacgagatcggcgccgaccgcaccgccagcatcgagaccctgatgaaccacctgcaggacaccagcctgaaccactgcaagagcgtgggcctgctgaacgacggcttcggccgcacccccgagatgtgcacccgcgacctgatctgggtgctgaccaagatgcagatcgtggtgaaccgctaccccacctggggcgacaccgtggagatcaacagctggttcagccagagcggcaagatcggcatgggccgcgagtggctgatcagcgactgcaacaccggcgagatcctggtgcgcgccaccagcgcctgggccatgatgaaccagaagacccgccgcttcagcaagctgccctgcgaggtgcgccaggagatcgccccccacttcgtggacgccccccccgtgatcgaggacaacgaccgcaagctgcacaagttcgacgtgaagaccggcgacagcatctgcaagggcctgacccccggctggaacgacttcgacgtgaaccagcacgtgagcaacgtgaagtacatcggctggattctggagagcatgcccaccgaggtgctggagacccaggagctgtgcagcctgaccctggagtaccgccgcgagtgcggccgcgagagcgtggtggagagcgtgaccagcatgaaccccagcaaggtgggcgaccgcagccagtaccagcacctgctgcgcctggaggacggcgccgacatcatgaagggccgcaccgagtggcgccccaagaacgccggcaccaaccgcgccatcagcacctgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 230 - DNA, 8964 bp, Artificial Sequence
  synthetic construct
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttccgcctggagctggtgcagagcatggggcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggtggtggccgccgccgccagcagcgccttcttccccgtgcccgccccccgccccacccccaagcccggcaagttcggcaactggcccagcagcctgagccagcccttcaagcccaagagcaaccccaacggccgcttccaggtgaaggccaacgtgagcccccacgggcgcgcccccaaggccaacggcagcgccgtgagcctgaagtccggcagcctgaacaccctggaggacccccccagcagcccccccccccgcaccttcctgaaccagctgcccgactggagccgcctgcgcaccgccatcaccaccgtgttcgtggccgccgagaagcagttcacccgcctggaccgcaagagcaagcgccccgacatgctggtggactggttcggcagcgagaccatcgtgcaggacggcctggtgttccgcgagcgcttcagcatccgcagctacgagatcggcgccgaccgcaccgccagcatcgagaccctgatgaaccacctgcaggacaccagcctgaaccactgcaagagcgtgggcctgctgaacgacggcttcggccgcacccccgagatgtgcacccgcgacctgatctgggtgctgaccaagatgcagatcgtggtgaaccgctaccccacctggggcgacaccgtggagatcaacagctggttcagccagagcggcaagatcggcatgggccgcgagtggctgatcagcgactgcaacaccggcgagatcctggtgcgcgccaccagcgcctgggccatgatgaaccagaagacccgccgcttcagcaagctgccctgcgaggtgcgccaggagatcgccccccacttcgtggacgccccccccgtgatcgaggacaacgaccgcaagctgcacaagttcgacgtgaagaccggcgacagcatctgcaagggcctgacccccggctggaacgacttcgacgtgaaccagcacgtgagcaacgtgaagtacatcggctggattctggagagcatgcccaccgaggtgctggagacccaggagctgtgcagcctgaccctggagtaccgccgcgagtgcggccgcgagagcgtggtggagagcgtgaccagcatgaaccccagcaaggtgggcgaccgcagccagtaccagcacctgctgcgcctggaggacggcgccgacatcatgaagggccgcaccgagtggcgccccaagaacgccggcaccaaccgcgccatcagcacctgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctccagccacggcaacaccgcgcgccttgcggccgagcacggcgacaagaacctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactactgccgcatcctggagcacctcaacgcgcgctggaaggtggacgagcgccaggtcagcggccaggccgccgcggaccaggagtacgtcctgggcctgccccagcgcttccggaaactcgccgagaagaccgccgccaagcgcaagcgcgtcgcgcgcaggcccgtcgccttctcctggagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 231 - DNA, 8901 bp, Artificial Sequence
  synthetic construct
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttccgcctggagctggtgcagagcatggggcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggctatcaagacgaacaggcagcctgtggagaagcctccgttcacgatcgggacgctgcgcaaggccatccccgcgcactgtttcgagcgctcggcgcttcgtgggcgcgcccccaaggccaacggcagcgccgtgagcctgaagtccggcagcctgaacaccctggaggacccccccagcagcccccccccccgcaccttcctgaaccagctgcccgactggagccgcctgcgcaccgccatcaccaccgtgttcgtggccgccgagaagcagttcacccgcctggaccgcaagagcaagcgccccgacatgctggtggactggttcggcagcgagaccatcgtgcaggacggcctggtgttccgcgagcgcttcagcatccgcagctacgagatcggcgccgaccgcaccgccagcatcgagaccctgatgaaccacctgcaggacaccagcctgaaccactgcaagagcgtgggcctgctgaacgacggcttcggccgcacccccgagatgtgcacccgcgacctgatctgggtgctgaccaagatgcagatcgtggtgaaccgctaccccacctggggcgacaccgtggagatcaacagctggttcagccagagcggcaagatcggcatgggccgcgagtggctgatcagcgactgcaacaccggcgagatcctggtgcgcgccaccagcgcctgggccatgatgaaccagaagacccgccgcttcagcaagctgccctgcgaggtgcgccaggagatcgccccccacttcgtggacgccccccccgtgatcgaggacaacgaccgcaagctgcacaagttcgacgtgaagaccggcgacagcatctgcaagggcctgacccccggctggaacgacttcgacgtgaaccagcacgtgagcaacgtgaagtacatcggctggattctggagagcatgcccaccgaggtgctggagacccaggagctgtgcagcctgaccctggagtaccgccgcgagtgcggccgcgagagcgtggtggagagcgtgaccagcatgaaccccagcaaggtgggcgaccgcagccagtaccagcacctgctgcgcctggaggacggcgccgacatcatgaagggccgcaccgagtggcgccccaagaacgccggcaccaaccgcgccatcagcacctgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctccagccacggcaacaccgcgcgccttgcggccgagcacggcgacaagaacctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactactgccgcatcctggagcacctcaacgcgcgctggaaggtggacgagcgccaggtcagcggccaggccgccgcggaccaggagtacgtcctgggcctgccccagcgcttccggaaactcgccgagaagaccgccgccaagcgcaagcgcgtcgcgcgcaggcccgtcgccttctcctggagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 232 - DNA, 12406 bp, artificial sequence
  synthetic polynucleotide
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagcccatatggcttccgcggcattcaccatgtcggcgtgccccgcgatgactggcagggcccctggggcacgtcgctccggacggccagtcgccacccgcctgaggtacgtattccagtgcctggtggccagctgcatcgacccctgcgaccagtaccgcagcagcgccagcctgagcttcctgggcgacaacggcttcgccagcctgttcggcagcaagcccttcatgagcaaccgcggccaccgccgcctgcgccgcgccagccacagcggcgaggccatggccgtggccctgcagcccgcccaggaggccggcaccaagaagaagcccgtgatcaagcagcgccgcgtggtggtgaccggcatgggcgtggtgacccccctgggccacgagcccgacgtgttctacaacaacctgctggacggcgtgagcggcatcagcgagatcgagaccttcgactgcacccagttccccacccgcatcgccggcgagatcaagagcttcagcaccgacggctgggtggcccccaagctgagcaagcgcatggacaagttcatgctgtacctgctgaccgccggcaagaaggccctggccgacggcggcatcaccgacgaggtgatgaaggagctggacaagcgcaagtgcggcgtgctgatcggcagcggcatgggcggcatgaaggtgttcaacgacgccatcgaggccctgcgcgtgagctacaagaagatgaaccccttctgcgtgcccttcgccaccaccaacatgggcagcgccatgctggccatggacctgggctggatgggccccaactacagcatcagcaccgcctgcgccaccagcaacttctgcatcctgaacgccgccaaccacatcatccgcggcgaggccgacatgatgctgtgcggcggcagcgacgccgtgatcatccccatcggcctgggcggcttcgtggcctgccgcgccctgagccagcgcaacagcgaccccaccaaggccagccgcccctgggacagcaaccgcgacggcttcgtgatgggcgagggcgccggcgtgctgctgctggaggagctggagcacgccaagaagcgcggcgccaccatctacgccgagttcctgggcggcagcttcacctgcgacgcctaccacatgaccgagccccaccccgagggcgccggcgtgatcctgtgcatcgagaaggccctggcccaggccggcgtgagcaaggaggacgtgaactacatcaacgcccacgccaccagcaccagcgccggcgacatcaaggagtaccaggccctggcccgctgcttcggccagaacagcgagctgcgcgtgaacagcaccaagagcatgatcggccacctgctgggcgccgccggcggcgtggaggccgtgaccgtggtgcaggccatccgcaccggctggattcaccccaacctgaacctggaggaccccgacaaggccgtggacgccaagctgctggtgggccccaagaaggagcgcctgaacgtgaaggtgggcctgagcaacagcttcggcttcggcggccacaacagcagcatcctgttcgccccctgcaacgtgtgaatgcatacggagcgtcgtgcgggagggagtgtgccgagcggggagtcccggtctgtgcgaggcccggcagctgacgctggcgagccgtacgccccgagggtccccctcccctcccccctcttccccttccctctgacggccgcgcctgtttttgcatgttcagcgaccttaaggatctaagtaagattcgaagcgctcgaccgtgccggacggactgcagccccatgtcgtagtgaccgccaatgtaagtgggctggcgtttccctgtacgtgactcaacgtcactgcacgcgcaccaccctctcgaccggcaggaccaggcatcgcgagatacagcgcgagccagacacggagtgccgagctatgcgcacgctccaactagatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgcccccaaggccaacggcagcgccgtgagcctgaagtccggcagcctgaacaccctggaggacccccccagcagcccccccccccgcaccttcctgaaccagctgcccgactggagccgcctgcgcaccgccatcaccaccgtgttcgtggccgccgagaagcagttcacccgcctggaccgcaagagcaagcgccccgacatgctggtggactggttcggcagcgagaccatcgtgcaggacggcctggtgttccgcgagcgcttcagcatccgcagctacgagatcggcgccgaccgcaccgccagcatcgagaccctgatgaaccacctgcaggacaccagcctgaaccactgcaagagcgtgggcctgctgaacgacggcttcggccgcacccccgagatgtgcacccgcgacctgatctgggtgctgaccaagatgcagatcgtggtgaaccgctaccccacctggggcgacaccgtggagatcaacagctggttcagccagagcggcaagatcggcatgggccgcgagtggctgatcagcgactgcaacaccggcgagatcctggtgcgcgccaccagcgcctgggccatgatgaaccagaagacccgccgcttcagcaagctgccctgcgaggtgcgccaggagatcgccccccacttcgtggacgccccccccgtgatcgaggacaacgaccgcaagctgcacaagttcgacgtgaagaccggcgacagcatctgcaagggcctgacccccggctggaacgacttcgacgtgaaccagcacgtgagcaacgtgaagtacatcggctggattctggagagcatgcccaccgaggtgctggagacccaggagctgtgcagcctgaccctggagtaccgccgcgagtgcggccgcgagagcgtggtggagagcgtgaccagcatgaaccccagcaaggtgggcgaccgcagccagtaccagcacctgctgcgcctggaggacggcgccgacatcatgaagggccgcaccgagtggcgccccaagaacgccggcaccaaccgcgccatcagcacctgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 233 - DNA, 9362 bp, artificial sequence
  synthetic polynucleotide
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgggctggtctgaatccttcaggcgggtgttacccgagaaagaaagggtgccgatttcaaagcagacccatgtgccgggccctgtggcctgtgttggcgcctatgtagtcaccccccctcacccaattgtcgccagtttgcgcactccataaactcaaaacagcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgccgccaccggcgagcagccctccggcgtggcctccctgcgcgaggccgacaaggagaagtccctgggcaaccgcctgcgcctgggctccctgaccgaggacggcctgtcctacaaggagaagttcgtgatccgctgctacgaggtgggcatcaacaagaccgccaccatcgagaccatcgccaacctgctgcaggaggtgggcggcaaccacgcccagggcgtgggcttctccaccgacggcttcgccaccaccaccaccatgcgcaagctgcacctgatctgggtgaccgcccgcatgcacatcgagatctaccgctaccccgcctggtccgacgtgatcgagatcgagacctgggtgcagggcgagggcaaggtgggcacccgccgcgactggatcctgaaggactacgccaacggcgaggtgatcggccgcgccacctccaagtgggtgatgatgaacgaggacacccgccgcctgcagaaggtgtccgacgacgtgcgcgaggagtacctggtgttctgcccccgcaccctgcgcctggccttccccgaggagaacaacaactccatgaagaagatccccaagctggaggaccccgccgagtactcccgcctgggcctggtgccccgccgctccgacctggacatgaacaagcacgtgaacaacgtgacctacatcggctgggccctggagtccatcccccccgagatcatcgacacccacgagctgcaggccatcaccctggactaccgccgcgagtgccagcgcgacgacatcgtggactccctgacctcccgcgagcccctgggcaacgccgccggcgtgaagttcaaggagatcaacggctccgtgtcccccaagaaggacgagcaggacctgtcccgcttcatgcacctgctgcgctccgccggctccggcctggagatcaaccgctgccgcaccgagtggcgcaagaagcccgccaagcgcatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgagcgcatcgaggtggtcatctccgacctggcgctggtggcggtgctcagcgggctcagcgtgctgggccgcaccatgggctgggcctggctggtcaagacctacgtggtgccctacctgatcgtgaacatgtggctcgtgctcatcacgctgctccagcacacgcacccggcgctgccgcactacttcgagaaggactgggactggctgcgcggcgccatggccaccgtggaccgctccatgggcccgcccttcatggacaacatcctgcaccacatctccgacacccacgtgctgcaccacctcttcagcaccatcccgcactaccacgccgaggaggcctccgccgccatcaggcccatcctgggcaagtactaccagtccgacagccgctgggtcggccgcgccctgtgggaggactggcgcgactgccgctacgtcgtcccggacgcgcccgaggacgactccgcgctctggttccacaagtgagtgagtgagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 234 - DNA, 8609 bp, Artificial Sequence
  synthetic polynucleotide
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgggctggtctgaatccttcaggcgggtgttacccgagaaagaaagggtgccgatttcaaagcagacccatgtgccgggccctgtggcctgtgttggcgcctatgtagtcaccccccctcacccaattgtcgccagtttgcgcactccataaactcaaaacagcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgccgccaccggcgagcagccctccggcgtggcctccctgcgcgaggccgacaaggagaagtccctgggcaaccgcctgcgcctgggctccctgaccgaggacggcctgtcctacaaggagaagttcgtgatccgctgctacgaggtgggcatcaacaagaccgccaccatcgagaccatcgccaacctgctgcaggaggtgggcggcaaccacgcccagggcgtgggcttctccaccgacggcttcgccaccaccaccaccatgcgcaagctgcacctgatctgggtgaccgcccgcatgcacatcgagatctaccgctaccccgcctggtccgacgtgatcgagatcgagacctgggtgcagggcgagggcaaggtgggcacccgccgcgactggatcctgaaggactacgccaacggcgaggtgatcggccgcgccacctccaagtgggtgatgatgaacgaggacacccgccgcctgcagaaggtgtccgacgacgtgcgcgaggagtacctggtgttctgcccccgcaccctgcgcctggccttccccgaggagaacaacaactccatgaagaagatccccaagctggaggaccccgccgagtactcccgcctgggcctggtgccccgccgctccgacctggacatgaacaagcacgtgaacaacgtgacctacatcggctgggccctggagtccatcccccccgagatcatcgacacccacgagctgcaggccatcaccctggactaccgccgcgagtgccagcgcgacgacatcgtggactccctgacctcccgcgagcccctgggcaacgccgccggcgtgaagttcaaggagatcaacggctccgtgtcccccaagaaggacgagcaggacctgtcccgcttcatgcacctgctgcgctccgccggctccggcctggagatcaaccgctgccgcaccgagtggcgcaagaagcccgccaagcgcatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgagcgcatcgaggtggtcatctccgacctggcgctggtggcggtgctcagcgggctcagcgtgctgggccgcaccatgggctgggcctggctggtcaagacctacgtggtgccctacctgatcgtgaacatgtggctcgtgctcatcacgctgctccagcacacgcacccggcgctgccgcactacttcgagaaggactgggactggctgcgcggcgccatggccaccgtggaccgctccatgggcccgcccttcatggacaacatcctgcaccacatctccgacacccacgtgctgcaccacctcttcagcaccatcccgcactaccacgccgaggaggcctccgccgccatcaggcccatcctgggcaagtactaccagtccgacagccgctgggtcggccgcgccctgtgggaggactggcgcgactgccgctacgtcgtcccggacgcgcccgaggacgactccgcgctctggttccacaagtgagtgagtgagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 235 - DNA, 9387 bp, artificial sequence
  synthetic polynucleotide
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggcttccgcggcattcaccatgtcggcgtgccccgcgatgactggcagggcccctggggcacgtcgctccggacggccagtcgccacccgcctgagggggcgcgcccccaaggccaacggctccgccgtgtccctgaagtccggctccctggacacccaggaggacacctcctcctcctcctcccccccccgcaccttcatcaaccagctgcccgactggtccatgctgctgtccgccatcaccaccgtgttcgtggccgccgagaagcagtggaccatgctggaccgcaagtccaagcgccccgacaccctgatggaccccttcggcgtggaccgcgtggtgcaggacggcgtggtgttccgccagtccttctccatccgctcctacgagatcggcgccgaccgcaccgcctccatcgagaccctgatgaacatcttccaggagacctccctgaaccactgcaagtccatcggcctgctgaacgacggcttcggccgcacccccgagatgtgcaagcgcgacctgatctgggtggtgaccaagatgcacatcgaggtgaaccgctaccccacctggggcgacaccatcgaggtgaacacctgggtgtccgagtccggcaagaccggcatgggccgcgactggctgatctccgactgccacaccggcgagatcctgatccgcgccacctccgtgtgcgccatgatgaaccagaccacccgccgcttctccaagttcccctacgaggtgcgccaggagctggccccccacttcgtggactccgcccccgtgatcgaggactaccagaagctgcacaagctggacgtgaagaccggcgactccatctgcaacggcctgaccccccgctggaacgacctggacgtgaaccagcacgtgaacaacgtgaagtacatcggctggattctggagtccgtgcccaaggaggtgttcgagacccaggagctgtgcggcctgaccctggagtaccgccgcgagtgcggccgcgactccgtgctgaagtccgtgaccgccatggacccctccaaggagggcgaccgctccctgtaccagcacctgctgcgcctggaggacggcaccgacatcgccaagggccgcaccaagtggcgccccaagaacgccggcaccaacggcgccatctccaccggcaagacctccaacggcaactccatctcctgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 236 - DNA, 7781 bp, artificial sequence
  synthetic polynucleotide
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 237 - DNA, 8831 bp, artificial sequence
  synthetic polynucleotide
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgccgcctccgccaaggcctccaagaccatcggcgagggctccgagaacctgaacgtgcgcggcatcatcgccaagcccacctcctcctccgccgccaagcagggcaaggtgatggcccaggccgtgcccaagatcaacggcgccaaggtgggcctgaaggccgagtcccagaaggccgaggaggacgccgccccctcctccgccccccgcaccttctacaaccagctgcccgactggtccgtgctgctggccgccgtgaccaccatcttcctggccgccgagaagcagtggaccctgctggactggaagccccgccgccccgacatgctgaccggcgccttctccctgggcaagatcgtgcaggacggcctggtgttccgccagaacttctccatccgctcctacgagatcggcgccgaccgcaccgcctccatcgagaccctgatgaaccacctgcaggagaccgccctgaaccacgtgcgcaacgccggcctgctgggcgacggcttcggcgccacccccgagatgtccaagcgcaacctgatctgggtggtgaccaagatgcaggtgctgatcgagcactacccctcctggggcgacgtggtggaggtggacacctgggtgggcgcctccggcaagaacggcatgcgccgcgactggcacgtgcgcgactaccgcaccggccagaccatcctgcgcgccacctccatctgggtgatgatggacaagcacacccgcaagctgtccaagatgcccgaggaggtgcgcgccgagatcggcccctacttcatggagcacgccgccatcgtggacgaggactcccgcaagctgcccaagctggacgacgacaccgccgactacatcaagtggggcctgaccccccgctggtccgacctggacgtgaaccagcacgtgaacaacgtgaagtacatcggctggatcctggagtccgcccccatctccatcctggagaaccacgagctggcctccatgaccctggagtaccgccgcgagtgcggccgcgactccgtgctgcagtccctgaccgccgtggccaacgactgcaccggcggcctgcccgaggcctccatcgagtgccagcacctgctgcagctggagtgcggcgccgagatcgtgcgcggccgcacccagtggcgcccccgccgcgcctccggccccacctccgccggctccgccatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 238 - DNA, 9380 bp, artificial sequence
  synthetic polynucleotide
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgcctcccagctgcgcaagcccgccctggaccccctgcgcgccgtgatctccgccgaccagggctccatctcccccgtgaactcctgcacccccgccgaccgcctgcgcgccggccgcctgatggaggacggctactcctacaaggagaagttcatcgtgcgctcctacgaggtgggcatcaacaagaccgccaccgtggagaccatcgccaacctgctgcaggaggtggcctgcaaccacgtgcagaagtgcggcttctccaccgacggcttcgccaccaccctgaccatgcgcaagctgcacctgatctgggtgaccgcccgcatgcacatcgagatctacaagtaccccgcctggtccgacgtggtggagatcgagacctggtgccagtccgagggccgcatcggcacccgccgcgactggatcctgcgcgactccgccaccaacgaggtgatcggccgcgccacctccaagtgggtgatgatgaaccaggacacccgccgcctgcagcgcgtgaccgacgaggtgcgcgacgagtacctggtgttctgcccccgcgagccccgcctggccttccccgaggagaacaactcctccctgaagaagatccccaagctggaggaccccgcccagtactccatgctggagctgaagccccgccgcgccgacctggacatgaaccagcacgtgaacaacgtgacctacatcggctgggtgctggagtccatcccccaggagatcatcgacacccacgagctgcaggtgatcaccctggactaccgccgcgagtgccagcaggacgacatcgtggactccctgaccacctccgagatccccgacgaccccatctccaagttcaccggcaccaacggctccgccatgtcctccatccagggccacaacgagtcccagttcctgcacatgctgcgcctgtccgagaacggccaggagatcaaccgcggccgcacccagtggcgcaagaagtcctcccgcatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 239 - DNA, 9359 bp, artificial sequence
  synthetic polynucleotide
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgccgccaccggcgagcagccctccggcgtggcctccctgcgcgaggccgacaaggagaagtccctgggcaaccgcctgcgcctgggctccctgaccgaggacggcctgtcctacaaggagaagttcgtgatccgctgctacgaggtgggcatcaacaagaccgccaccatcgagaccatcgccaacctgctgcaggaggtgggcggcaaccacgcccagggcgtgggcttctccaccgacggcttcgccaccaccaccaccatgcgcaagctgcacctgatctgggtgaccgcccgcatgcacatcgagatctaccgctaccccgcctggtccgacgtgatcgagatcgagacctgggtgcagggcgagggcaaggtgggcacccgccgcgactggatcctgaaggactacgccaacggcgaggtgatcggccgcgccacctccaagtgggtgatgatgaacgaggacacccgccgcctgcagaaggtgtccgacgacgtgcgcgaggagtacctggtgttctgcccccgcaccctgcgcctggccttccccgaggagaacaacaactccatgaagaagatccccaagctggaggaccccgccgagtactcccgcctgggcctggtgccccgccgctccgacctggacatgaacaagcacgtgaacaacgtgacctacatcggctgggccctggagtccatcccccccgagatcatcgacacccacgagctgcaggccatcaccctggactaccgccgcgagtgccagcgcgacgacatcgtggactccctgacctcccgcgagcccctgggcaacgccgccggcgtgaagttcaaggagatcaacggctccgtgtcccccaagaaggacgagcaggacctgtcccgcttcatgcacctgctgcgctccgccggctccggcctggagatcaaccgctgccgcaccgagtggcgcaagaagcccgccaagcgcatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 240 - DNA, 9461 bp, artificial sequence
  synthetic polynucleotide
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgccgccaacgcccaggcccccaccaagatcaacggctccaccgacgacgcccagctgcccgccccccgcaccttcatcaaccagctgcccgactggtccatgctgctggccgccatcaccaccgtgttcctggccgccgagaagcagtggatgatgctggactggaagccccgccgccccgacatgctgatcgacaccttcggcctgggccgcatcgtgcaggacggcctggtgttccgccagaacttctccatccgctcctacgagatcggcgccgaccgcaccgcctccatcgagaccgtgatgaaccacctgcaggagaccgccctgaaccacgtgaagaccgccggcctgctgggcgacggcttcggctccacccccgagatgtccaagcgcaacctgatctgggtggtgaccaagatgcaggtggaggtggaccgctaccccacctggggcgacgtggtgcaggtggacacctgggtgtccgcctccggcaagaacggcatgcgccgcgactggctgctgcgcgacggcaacaccggcgagaccctgacccgcgcctcctccgtgtgggtgatgatgaacaagctgacccgccgcctgtccaagatccccgaggaggtgcgcgaggagatcggctcctacttcgtgaactccgaccccgtggtggaggaggacggccgcaaggtgaccaagctggacgacaacaccgccgacttcgtgcgcaagggcctgacccccaagtggaacgacctggacatcaaccagcacgtgaacaacgtgaagtacatcggctggatcctggagtccgccccccagcccatcctggagacccgcgagctgtccgccgtgaccctggagtaccgccgcgagtgcggccgcgactccgtgctgcgctccctgaccgccgtgtccggcggcggcgtgggcgacctgggccacgccggcaacgtggagtgccagcacgtgctgcgcctggaggacggcgccgagatcgtgcgcggccgcaccgagtggcgccccaagtacatcaacaacttctccatcatgggccagatccccaccgacgcctccatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 241 - DNA, 8872 bp, Artificial Sequence
  synthetic construct
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttccgcctggagctggtgcagagcatggggcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttcagcgccgccgagaagcagtggaccaacctggagtggaagcccaagcccaagctgccccagctgctggacgaccacttcggcctgcacggcctggtgttccgccgcaccttcgccatccgctcctacgaggtgggccccgaccgcagcacctccatcctggccgtgatgaaccacatgcaggaggccaccctgaaccacgccaagagcgtgggcatcctgggcgacggcttcggcaccaccctggagatgtccaagcgcgacctgatgtgggtggtgcgccgcacccacgtggccgtggagcgctaccccacctggggcgacaccgtggaggtggagtgctggatcggcgccagcggcaacaacggcatgcgccgcgacttcctggtgcgcgactgcaagaccggcgagatcctgacccgctgcacctccctgagcgtgctgatgaacacccgcacccgccgcctgagcaccatccccgacgaggtgcgcggcgagatcggccccgccttcatcgacaacgtggccgtgaaggacgacgagatcaagaagctgcagaagctgaacgactccaccgccgactacatccagggcggcctgaccccccgctggaacgacctggacgtgaaccagcacgtgaacaacctgaagtacgtggcctgggtgttcgagaccgtgcccgacagcatcttcgagtcccaccacatcagctccttcaccctggagtaccgccgcgagtgcacccgcgactccgtgctgcgcagcctgaccaccgtgagcggcggcagctccgaggccggcctggtgtgcgaccacctgctgcagctggagggcggcagcgaggtgctgcgcgcccgcaccgagtggcgccccaagctgaccgactccttccgcggcatcagcgtgatccccgccgagccccgcgtgatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctccagccacggcaacaccgcgcgccttgcggccgagcacggcgacaagaacctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactactgccgcatcctggagcacctcaacgcgcgctggaaggtggacgagcgccaggtcagcggccaggccgccgcggaccaggagtacgtcctgggcctgccccagcgcttccggaaactcgccgagaagaccgccgccaagcgcaagcgcgtcgcgcgcaggcccgtcgccttctcctggagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 242 - DNA, 8830 bp, artificial sequence
  synthetic polynucleotide
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttccgcctggagctggtgcagagcatggggcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgcccagctgcccgactggagcatgctgctggccgcgatcaccaccctgttcctggcggccgagaagcagtggatgatgctggactggaagcccaagcgccccgacatgctggtggaccccttcggcctgggccgcttcgtgcaggacggcctggtgttccgcaacaacttcagcatccgcagctacgagatcggcgcggaccgcaccgccagcatcgagaccctgatgaaccacctgcaggagaccgccctgaaccacgtgaagagtgtgggcctgctggaggacggcctgggcagcacccgcgagatgagcctgcgcaacctgatctgggtggtgaccaagatgcaggtggcggtggaccgctaccccacctggggcgacgaggtgcaggtgagcagctgggcgaccgccatcggcaagaacggcatgcgccgcgagtggatcgtgaccgacttccgcaccggcgagaccctgctgcgcgccaccagcgtgtgggtgatgatgaacaagctgacccgccgcatcagcaagatccccgaggaggtgtggcacgagatcggccccagcttcatcgacgcgccccccctgcccaccgtggaggacgacggccgcaagctgacccgcttcgacgagagcagcgccgacttcatccgcaagggcctgaccccccgctggagcgacctggacatcaaccagcacgtgaacaacgtgaagtacatcggctggctgctggagagcgcgccccccgagatccacgagagccacgagatcgccagcctgaccctggagtaccgccgcgagtgcggccgcgacagcgtgctgaacagcgccaccaaggtgagcgacagcagccagctgggcaagagcgccgtggagtgcaaccacctggtgcgcctgcagaacggcggcgagatcgtgaagggccgcaccgtgtggcgccccaagcgccccctgtacaacgacggcgccgtggtggacgtgcccgccaagaccagctgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctccagccacggcaacaccgcgcgccttgcggccgagcacggcgacaagaacctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactactgccgcatcctggagcacctcaacgcgcgctggaaggtggacgagcgccaggtcagcggccaggccgccgcggaccaggagtacgtcctgggcctgccccagcgcttccggaaactcgccgagaagaccgccgccaagcgcaagcgcgtcgcgcgcaggcccgtcgccttctcctggagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 243 - DNA, 4674 bp, Cuphea hookeriana; identical to SEQ ID NO: 52

SEQ ID NO: 244 - DNA, 1170 bp, Cuphea hookeriana
atggccaccgcatccactttctcggcgttcaatgcccgctgcggcgacctgcgtcgctcggcgggctccgggccccggcgcccagcgaggcccctccccgtgcgcgggcgcgcccagctgcccgactggagccgcctgctgaccgccatcaccaccgtgttcgtgaagtccaagcgccccgacatgcacgaccgcaagtccaagcgccccgacatgctggtggacagcttcggcctggagtccaccgtgcaggacggcctggtgttccgccagtccttctccatccgctcctacgagatcggcaccgaccgcaccgccagcatcgagaccctgatgaaccacctgcaggagacctccctgaaccactgcaagagcaccggcatcctgctggacggcttcggccgcaccctggagatgtgcaagcgcgacctgatctgggtggtgatcaagatgcagatcaaggtgaaccgctaccccgcctggggcgacaccgtggagatcaacacccgcttcagccgcctgggcaagatcggcatgggccgcgactggctgatctccgactgcaacaccggcgagatcctggtgcgcgccaccagcgcctacgccatgatgaaccagaagacccgccgcctgtccaagctgccctacgaggtgcaccaggagatcgtgcccctgttcgtggacagccccgtgatcgaggactccgacctgaaggtgcacaagttcaaggtgaagaccggcgacagcatccagaagggcctgacccccggctggaacgacctggacgtgaaccagcacgtgtccaacgtgaagtacatcggctggatcctggagagcatgcccaccgaggtgctggagacccaggagctgtgctccctggccctggagtaccgccgcgagtgcggccgcgactccgtgctggagagcgtgaccgccatggaccccagcaaggtgggcgtgcgctcccagtaccagcacctgctgcgcctggaggacggcaccgccatcgtgaacggcgccaccgagtggcgccccaagaacgccggcgccaacggcgccatctccaccggcaagaccagcaacggcaactccgtgtccatggactacaaggaccacgacggcgactacaaggaccacgacatcgactacaaggacgacgacgacaagtga

SEQ ID NO: 245 - DNA, 5123 bp, Cuphea hookeriana
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagatctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtggcgcgccatggcgaccgccagctgcatggtggcgtcgcccttctgcacctggctggtcgccgcgtgcatgcccacctccagcgacaacgacccccgctcgctgtcccacaagcgcctgcgcctgagccgccgccgccgcaccctgagctcgcactgctccctgcgcggcagcaccttccagtgcctggacccctgcaaccagcagcgcttcctgggcgacaacggcttcgcgtcgctgttcggctccaagcccctgcgcagcaaccgcggccacctgcgcctgggccgcacctcgcactccggcgaggtgatggccgtcgcgatgcagcccgcccaggaggtgagcaccaacaagaagcccgcgaccaagcagcgccgcgtggtcgtgaccggcatgggcgtcgtgacccccctgggccacgaccccgacgtgtattataacaacctgctggacggcatctcgggcatctccgagatcgagaacttcgactgcagccagttccccacccgcatcgccggcgagatcaagtcgttctccaccgacggctgggtcgcgcccaagttcagcgagcgcatggacaagttcatgctgtatatgctgaccgccggcaagaaggcgctggccgacggcggcatcaccgaggacgcgatgaaggagctgaacaagcgcaagtgcggcgtgctgatcggctcgggcctgggcggcatgaaggtcttctccgacagcatcgaggccctgcgcacctcgtataagaagatctcccccttctgcgtgcccttcagcaccaccaacatgggctcggcgatcctggcgatggacctgggctggatgggccccaactattccatcagcaccgcgtgcgccacctcgaacttctgcatcctgaacgcggccaaccacatcatcaagggcgaggcggacatgatgctgtgcggcggctccgacgccgcggtgctgcccgtcggcctgggcggcttcgtggcctgccgcgcgctgagccagcgcaacaacgaccccaccaaggcctcgcgcccctgggactccaaccgcgacggcttcgtcatgggcgagggcgcgggcgtgctgctgctggaggagctggagcacgccaagaagcgcggcgcgaccatctatgccgagttcctgggcggcagcttcacctgcgacgcgtatcacatgaccgagccccaccccgagggcgccggcgtcatcctgtgcatcgagaaggcgctggcccagtcgggcgtgtcccgcgaggacgtgaactatatcaacgcgcacgccaccagcacccccgcgggcgacatcaaggagtatcaggccctggcgcactgcttcggccagaactcggagctgcgcgtcaactccaccaagagcatgatcggccacctgctgggcggcgccggcggcgtggaggcggtcgccgtggtccaggcgatccgcaccggctggatccaccccaacatcaacctggaggaccccgacgagggcgtggacgccaagctgctggtcggccccaagaaggagaagctgaaggtgaaggtcggcctgtcgaactccttcggcttcggcggccacaacagctcgatcctgttcgcgccctgcaactgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctc

SEQ ID NO: 246 - DNA, 1605 bp, Cuphea hookeriana
atggcgaccgccagctgcatggtggcgtcgcccttctgcacctggctggtcgccgcgtgcatgcccacctccagcgacaacgacccccgctcgctgtcccacaagcgcctgcgcctgagccgccgccgccgcaccctgagctcgcactgctccctgcgcggcagcaccttccagtgcctggacccctgcaaccagcagcgcttcctgggcgacaacggcttcgcgtcgctgttcggctccaagcccctgcgcagcaaccgcggccacctgcgcctgggccgcacctcgcactccggcgaggtgatggccgtcgcgatgcagcccgcccaggaggtgagcaccaacaagaagcccgcgaccaagcagcgccgcgtggtcgtgaccggcatgggcgtcgtgacccccctgggccacgaccccgacgtgtattataacaacctgctggacggcatctcgggcatctccgagatcgagaacttcgactgcagccagttccccacccgcatcgccggcgagatcaagtcgttctccaccgacggctgggtcgcgcccaagttcagcgagcgcatggacaagttcatgctgtatatgctgaccgccggcaagaaggcgctggccgacggcggcatcaccgaggacgcgatgaaggagctgaacaagcgcaagtgcggcgtgctgatcggctcgggcctgggcggcatgaaggtcttctccgacagcatcgaggccctgcgcacctcgtataagaagatctcccccttctgcgtgcccttcagcaccaccaacatgggctcggcgatcctggcgatggacctgggctggatgggccccaactattccatcagcaccgcgtgcgccacctcgaacttctgcatcctgaacgcggccaaccacatcatcaagggcgaggcggacatgatgctgtgcggcggctccgacgccgcggtgctgcccgtcggcctgggcggcttcgtggcctgccgcgcgctgagccagcgcaacaacgaccccaccaaggcctcgcgcccctgggactccaaccgcgacggcttcgtcatgggcgagggcgcgggcgtgctgctgctggaggagctggagcacgccaagaagcgcggcgcgaccatctatgccgagttcctgggcggcagcttcacctgcgacgcgtatcacatgaccgagccccaccccgagggcgccggcgtcatcctgtgcatcgagaaggcgctggcccagtcgggcgtgtcccgcgaggacgtgaactatatcaacgcgcacgccaccagcacccccgcgggcgacatcaaggagtatcaggccctggcgcactgcttcggccagaactcggagctgcgcgtcaactccaccaagagcatgatcggccacctgctgggcggcgccggcggcgtggaggcggtcgccgtggtccaggcgatccgcaccggctggatccaccccaacatcaacctggaggaccccgacgagggcgtggacgccaagctgctggtcggccccaagaaggagaagctgaaggtgaaggtcggcctgtcgaactccttcggcttcggcggccacaacagctcgatcctgttcgcgccctgcaactga

SEQ ID NO: 247 - protein, 534 aa, Cuphea hookeriana; identical to SEQ ID NO: 186

SEQ ID NO: 248 - DNA, 7843 bp, Cuphea hookeriana
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagatctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggagtttaggtccagcgtccgtggggggggacgggctgggagcttgggccgggaagggcaagacgatgcagtccctctggggagtcacagccgactgtgtgtgttgcactgtgcggcccgcagcactcacacgcaaaatgcctggccgacaggcaggccctgtccagtgcaacatccacggtccctctcatcaggctcaccttgctcattgacataacggaatgcgtaccgctctttcagatctgtccatccagagaggggagcaggctccccaccgacgctgtcaaacttgcttcctgcccaaccgaaaacattattgtttgagggggggggggggggggcagattgcatggcgggatatctcgtgaggaacatcactgggacactgtggaacacagtgagtgcagtatgcagagcatgtatgctaggggtcagcgcaggaagggggcctttcccagtctcccatgccactgcaccgtatccacgactcaccaggaccagcttcttgatcggcttccgctcccgtggacaccagtgtgtagcctctggactccaggtatgcgtgcaccgcaaaggccagccgatcgtgccgattcctggggtggaggatatgagtcagccaacttggggctcagagtgcacactggggcacgatacgaaacaacatctacaccgtgtcctccatgctgacacaccacagcttcgctccacctgaatgtgggcgcatgggcccgaatcacagccaatgtcgctgctgccataatgtgatccagaccctctccgcccagatgccgagcggatcgtgggcgctgaatagattcctgtttcgatcactgtttgggtcctttccttttcgtctcggatgcgcgtctcgaaacaggctgcgtcgggctttcggatcccttttgctccctccgtcaccatcctgcgcgcgggcaagttgcttgaccctgggctggtaccagggttggagggtattaccgcgtcaggccattcccagcccggattcaattcaaagtctgggccaccaccctccgccgctctgtctgatcactccacattcgtgcatacactacgttcaagtcctgatccaggcgtgtctcgggacaaggtgtgcttgagtttgaatctcaaggacccactccagcacagctgctggttgaccccgccctcgcaacatatggcgaccgccagctgcatggtggcgtcgcccttctgcacctggctggtcgccgcgtgcatgcccacctccagcgacaacgacccccgctcgctgtcccacaagcgcctgcgcctgagccgccgccgccgcaccctgagctcgcactgctccctgcgcggcagcaccttccagtgcctggacccctgcaaccagcagcgcttcctgggcgacaacggcttcgcgtcgctgttcggctccaagcccctgcgcagcaaccgcggccacctgcgcctgggccgcacctcgcactccggcgaggtgatggccgtcgcgatgcagcccgcccaggaggtgagcaccaacaagaagcccgcgaccaagcagcgccgcgtggtcgtgaccggcatgggcgtcgtgacccccctgggccacgaccccgacgtgtattataacaacctgctggacggcatctcgggcatctccgagatcgagaacttcgactgcagccagttccccacccgcatcgccggcgagatcaagtcgttctccaccgacggctgggtcgcgcccaagttcagcgagcgcatggacaagttcatgctgtatatgctgaccgccggcaagaaggcgctggccgacggcggcatcaccgaggacgcgatgaaggagctgaacaagcgcaagtgcggcgtgctgatcggctcgggcctgggcggcatgaaggtcttctccgacagcatcgaggccctgcgcacctcgtataagaagatctcccccttctgcgtgcccttcagcaccaccaacatgggctcggcgatcctggcgatggacctgggctggatgggccccaactattccatcagcaccgcgtgcgccacctcgaacttctgcatcctgaacgcggccaaccacatcatcaagggcgaggcggacatgatgctgtgcggcggctccgacgccgcggtgctgcccgtcggcctgggcggcttcgtggcctgccgcgcgctgagccagcgcaacaacgaccccaccaaggcctcgcgcccctgggactccaaccgcgacggcttcgtcatgggcgagggcgcgggcgtgctgctgctggaggagctggagcacgccaagaagcgcggcgcgaccatctatgccgagttcctgggcggcagcttcacctgcgacgcgtatcacatgaccgagccccaccccgagggcgccggcgtcatcctgtgcatcgagaaggcgctggcccagtcgggcgtgtcccgcgaggacgtgaactatatcaacgcgcacgccaccagcacccccgcgggcgacatcaaggagtatcaggccctggcgcactgcttcggccagaactcggagctgcgcgtcaactccaccaagagcatgatcggccacctgctgggcggcgccggcggcgtggaggcggtcgccgtggtccaggcgatccgcaccggctggatccaccccaacatcaacctggaggaccccgacgagggcgtggacgccaagctgctggtcggccccaagaaggagaagctgaaggtgaaggtcggcctgtcgaactccttcggcttcggcggccacaacagctcgatcctgttcgcgccctgcaactgatgcatacggagcgtcgtgcgggagggagtgtgccgagcggggagtcccggtctgtgcgaggcccggcagctgacgctggcgagccgtacgccccgagggtccccctcccctcccccctcttccccttccctctgacggccgcgcctgtttttgcatgttcagcgaccttaaggcgctcgaccgtgccggacggactgcagccccatgtcgtagtgaccgccaatgtaagtgggctggcgtttccctgtacgtgagctcaacgtcactgcacgcgcaccaccctctcgaccggcaggaccaggcatcgcgagatacagcgcgagccagacacggagtgccgagctatgcgcacgctccaactagatatcatgtggatgatgagcatgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggctatcaagacgaacaggcagcctgtggagaagcctccgttcacgatcgggacgctgcgcaaggccatccccgcgcactgtttcgagcgctcggcgcttcgtgggcgcgcccagctgcccgactggagccgcctgctgaccgccatcaccaccgtgttcgtgaagtccaagcgccccgacatgcacgaccgcaagtccaagcgccccgacatgctggtggacagcttcggcctggagtccaccgtgcaggacggcctggtgttccgccagtccttctccatccgctcctacgagatcggcaccgaccgcaccgccagcatcgagaccctgatgaaccacctgcaggagacctccctgaaccactgcaagagcaccggcatcctgctggacggcttcggccgcaccctggagatgtgcaagcgcgacctgatctgggtggtgatcaagatgcagatcaaggtgaaccgctaccccgcctggggcgacaccgtggagatcaacacccgcttcagccgcctgggcaagatcggcatgggccgcgactggctgatctccgactgcaacaccggcgagatcctggtgcgcgccaccagcgcctacgccatgatgaaccagaagacccgccgcctgtccaagctgccctacgaggtgcaccaggagatcgtgcccctgttcgtggacagccccgtgatcgaggactccgacctgaaggtgcacaagttcaaggtgaagaccggcgacagcatccagaagggcctgacccccggctggaacgacctggacgtgaaccagcacgtgtccaacgtgaagtacatcggctggatcctggagagcatgcccaccgaggtgctggagacccaggagctgtgctccctggccctggagtaccgccgcgagtgcggccgcgactccgtgctggagagcgtgaccgccatggaccccagcaaggtgggcgtgcgctcccagtaccagcacctgctgcgcctggaggacggcaccgccatcgtgaacggcgccaccgagtggcgccccaagaacgccggcgccaacggcgccatctccaccggcaagaccagcaacggcaactccgtgtccatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctc

SEQ ID NO: 249 - DNA, 1239 bp, Artificial Sequence; identical to SEQ ID NO: 39
  synthesized polynucleotide

SEQ ID NO: 250 - DNA, 4656 bp, Umbellularia californica; identical to SEQ ID NO: 53

SEQ ID NO: 251 - DNA, 1152 bp, Umbellularia californica
atggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttcagcgccgccgagaagcagtggaccaacctggagtggaagcccaagcccaagctgccccagctgctggacgaccacttcggcctgcacggcctggtgttccgccgcaccttcgccatccgctcctacgaggtgggccccgaccgcagcacctccatcctggccgtgatgaaccacatgcaggaggccaccctgaaccacgccaagagcgtgggcatcctgggcgacggcttcggcaccaccctggagatgtccaagcgcgacctgatgtgggtggtgcgccgcacccacgtggccgtggagcgctaccccacctggggcgacaccgtggaggtggagtgctggatcggcgccagcggcaacaacggcatgcgccgcgacttcctggtgcgcgactgcaagaccggcgagatcctgacccgctgcacctccctgagcgtgctgatgaacacccgcacccgccgcctgagcaccatccccgacgaggtgcgcggcgagatcggccccgccttcatcgacaacgtggccgtgaaggacgacgagatcaagaagctgcagaagctgaacgactccaccgccgactacatccagggcggcctgaccccccgctggaacgacctggacgtgaaccagcacgtgaacaacctgaagtacgtggcctgggtgttcgagaccgtgcccgacagcatcttcgagtcccaccacatcagctccttcaccctggagtaccgccgcgagtgcacccgcgactccgtgctgcgcagcctgaccaccgtgagcggcggcagctccgaggccggcctggtgtgcgaccacctgctgcagctggagggcggcagcgaggtgctgcgcgcccgcaccgagtggcgccccaagctgaccgactccttccgcggcatcagcgtgatccccgccgagccccgcgtgatggactacaaggaccacgacggcgactacaaggaccacgacatcgactacaaggacgacgacgacaagtga

SEQ ID NO: 252 - DNA, 6789 bp, Garcinia mangostana
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgccgccaacgcccaggcccccaccaagatcaacggctccaccgacgacgcccagctgcccgccccccgcaccttcatcaaccagctgcccgactggtccatgctgctggccgccatcaccaccgtgttcctggccgccgagaagcagtggatgatgctggactggaagccccgccgccccgacatgctgatcgacaccttcggcctgggccgcatcgtgcaggacggcctggtgttccgccagaacttctccatccgctcctacgagatcggcgccgaccgcaccgcctccatcgagaccgtgatgaaccacctgcaggagaccgccctgaaccacgtgaagaccgccggcctgctgggcgacggcttcggctccacccccgagatgtccaagcgcaacctgatctgggtggtgaccaagatgcaggtggaggtggaccgctaccccacctggggcgacgtggtgcaggtggacacctgggtgtccgcctccggcaagaacggcatgcgccgcgactggctgctgcgcgacggcaacaccggcgagaccctgacccgcgcctcctccgtgtgggtgatgatgaacaagctgacccgccgcctgtccaagatccccgaggaggtgcgcgaggagatcggctcctacttcgtgaactccgaccccgtggtggaggaggacggccgcaaggtgaccaagctggacgacaacaccgccgacttcgtgcgcaagggcctgacccccaagtggaacgacctggacatcaaccagcacgtgaacaacgtgaagtacatcggctggatcctggagtccgccccccagcccatcctggagacccgcgagctgtccgccgtgaccctggagtaccgccgcgagtgcggccgcgactccgtgctgcgctccctgaccgccgtgtccggcggcggcgtgggcgacctgggccacgccggcaacgtggagtgccagcacgtgctgcgcctggaggacggcgccgagatcgtgcgcggccgcaccgagtggcgccccaagtacatcaacaacttctccatcatgggccagatccccaccgacgcctccatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 253 - DNA, 1257 bp, Garcinia mangostana
atggccaccgcatccactttctcggcgttcaatgcccgctgcggcgacctgcgtcgctcggcgggctccgggccccggcgcccagcgaggcccctccccgtgcgcgggcgcgccgccaacgcccaggcccccaccaagatcaacggctccaccgacgacgcccagctgcccgccccccgcaccttcatcaaccagctgcccgactggtccatgctgctggccgccatcaccaccgtgttcctggccgccgagaagcagtggatgatgctggactggaagccccgccgccccgacatgctgatcgacaccttcggcctgggccgcatcgtgcaggacggcctggtgttccgccagaacttctccatccgctcctacgagatcggcgccgaccgcaccgcctccatcgagaccgtgatgaaccacctgcaggagaccgccctgaaccacgtgaagaccgccggcctgctgggcgacggcttcggctccacccccgagatgtccaagcgcaacctgatctgggtggtgaccaagatgcaggtggaggtggaccgctaccccacctggggcgacgtggtgcaggtggacacctgggtgtccgcctccggcaagaacggcatgcgccgcgactggctgctgcgcgacggcaacaccggcgagaccctgacccgcgcctcctccgtgtgggtgatgatgaacaagctgacccgccgcctgtccaagatccccgaggaggtgcgcgaggagatcggctcctacttcgtgaactccgaccccgtggtggaggaggacggccgcaaggtgaccaagctggacgacaacaccgccgacttcgtgcgcaagggcctgacccccaagtggaacgacctggacatcaaccagcacgtgaacaacgtgaagtacatcggctggatcctggagtccgccccccagcccatcctggagacccgcgagctgtccgccgtgaccctggagtaccgccgcgagtgcggccgcgactccgtgctgcgctccctgaccgccgtgtccggcggcggcgtgggcgacctgggccacgccggcaacgtggagtgccagcacgtgctgcgcctggaggacggcgccgagatcgtgcgcggccgcaccgagtggcgccccaagtacatcaacaacttctccatcatgggccagatccccaccgacgcctccatggactacaaggaccacgacggcgactacaaggaccacgacatcgactacaaggacgacgacgacaagtga

SEQ ID NO: 254 - DNA, 6707 bp, Brassica napus
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatgctgaagctgtcctgcaacgtgaccaacaacctgcacaccttctccttcttctccgactcctccctgttcatccccgtgaaccgccgcaccatcgccgtgtcctccgggcgcgcctcccagctgcgcaagcccgccctggaccccctgcgcgccgtgatctccgccgaccagggctccatctcccccgtgaactcctgcacccccgccgaccgcctgcgcgccggccgcctgatggaggacggctactcctacaaggagaagttcatcgtgcgctcctacgaggtgggcatcaacaagaccgccaccgtggagaccatcgccaacctgctgcaggaggtggcctgcaaccacgtgcagaagtgcggcttctccaccgacggcttcgccaccaccctgaccatgcgcaagctgcacctgatctgggtgaccgcccgcatgcacatcgagatctacaagtaccccgcctggtccgacgtggtggagatcgagacctggtgccagtccgagggccgcatcggcacccgccgcgactggatcctgcgcgactccgccaccaacgaggtgatcggccgcgccacctccaagtgggtgatgatgaaccaggacacccgccgcctgcagcgcgtgaccgacgaggtgcgcgacgagtacctggtgttctgcccccgcgagccccgcctggccttccccgaggagaacaactcctccctgaagaagatccccaagctggaggaccccgcccagtactccatgctggagctgaagccccgccgcgccgacctggacatgaaccagcacgtgaacaacgtgacctacatcggctgggtgctggagtccatcccccaggagatcatcgacacccacgagctgcaggtgatcaccctggactaccgccgcgagtgccagcaggacgacatcgtggactccctgaccacctccgagatccccgacgaccccatctccaagttcaccggcaccaacggctccgccatgtcctccatccagggccacaacgagtcccagttcctgcacatgctgcgcctgtccgagaacggccaggagatcaaccgcggccgcacccagtggcgcaagaagtcctcccgcatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 255 - DNA, 1179 bp, Brassica napus
atgctgaagctgtcctgcaacgtgaccaacaacctgcacaccttctccttcttctccgactcctccctgttcatccccgtgaaccgccgcaccatcgccgtgtcctccgggcgcgcctcccagctgcgcaagcccgccctggaccccctgcgcgccgtgatctccgccgaccagggctccatctcccccgtgaactcctgcacccccgccgaccgcctgcgcgccggccgcctgatggaggacggctactcctacaaggagaagttcatcgtgcgctcctacgaggtgggcatcaacaagaccgccaccgtggagaccatcgccaacctgctgcaggaggtggcctgcaaccacgtgcagaagtgcggcttctccaccgacggcttcgccaccaccctgaccatgcgcaagctgcacctgatctgggtgaccgcccgcatgcacatcgagatctacaagtaccccgcctggtccgacgtggtggagatcgagacctggtgccagtccgagggccgcatcggcacccgccgcgactggatcctgcgcgactccgccaccaacgaggtgatcggccgcgccacctccaagtgggtgatgatgaaccaggacacccgccgcctgcagcgcgtgaccgacgaggtgcgcgacgagtacctggtgttctgcccccgcgagccccgcctggccttccccgaggagaacaactcctccctgaagaagatccccaagctggaggaccccgcccagtactccatgctggagctgaagccccgccgcgccgacctggacatgaaccagcacgtgaacaacgtgacctacatcggctgggtgctggagtccatcccccaggagatcatcgacacccacgagctgcaggtgatcaccctggactaccgccgcgagtgccagcaggacgacatcgtggactccctgaccacctccgagatccccgacgaccccatctccaagttcaccggcaccaacggctccgccatgtcctccatccagggccacaacgagtcccagttcctgcacatgctgcgcctgtccgagaacggccaggagatcaaccgcggccgcacccagtggcgcaagaagtcctcccgcatggactacaaggaccacgacggcgactacaaggaccacgacatcgactacaaggacgacgacgacaagtga

SEQ ID NO: 256 - DNA, 5988 bp, artificial sequence
  synthetic polynucleotide
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgccgaggtgcacgtgcaggtgacccactccctggcccccgagaagcgcgagatcttcaactccctgaacaactgggcccaggagaacatcctggtgctgctgaaggacgtggacaagtgctggcagccctccgacttcctgcccgactccgcctccgagggcttcgacgagcaggtgatggagctgcgcaagcgctgcaaggagatccccgacgactacttcatcgtgctggtgggcgacatgatcaccgaggaggccctgcccacctaccagaccatgctgaacaccctggacggcgtgcgcgacgagaccggcgcctccctgaccccctgggccatctggacccgcgcctggaccgccgaggagaaccgccacggcgacctgctgaacaagtacctgtacctgtccggccgcgtggacatgaagcagatcgagaagaccatccagtacctgatcggctccggcatggacccccgcaccgagaacaacccctacctgggcttcatctacacctccttccaggagcgcgccaccttcatctcccacggcaacaccgcccgcctggccaaggagcacggcgacctgaagctggcccagatctgcggcatcatcgccgccgacgagaagcgccacgagaccgcctacaccaagatcgtggagaagctgttcgagatcgaccccgacggcaccgtgctggccctggccgacatgatgcgcaagaaggtgtccatgcccgcccacctgatgtacgacggccaggacgacaacctgttcgagaacttctcctccgtggcccagcgcctgggcgtgtacaccgccaaggactacgccgacatcctggagttcctggtgggccgctgggacatcgagaagctgaccggcctgtccggcgagggccgcaaggcccaggactacgtgtgcaccctgcccccccgcatccgccgcctggaggagcgcgcccagtcccgcgtgaagaaggcctccgccacccccttctcctggatcttcggccgcgagatcaacctgatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 257 - DNA, 1209 bp, artificial sequence
  synthetic polynucleotide
atggccaccgcatccactttctcggcgttcaatgcccgctgcggcgacctgcgtcgctcggcgggctccgggccccggcgcccagcgaggcccctccccgtgcgcgggcgcgccgaggtgcacgtgcaggtgacccactccctggcccccgagaagcgcgagatcttcaactccctgaacaactgggcccaggagaacatcctggtgctgctgaaggacgtggacaagtgctggcagccctccgacttcctgcccgactccgcctccgagggcttcgacgagcaggtgatggagctgcgcaagcgctgcaaggagatccccgacgactacttcatcgtgctggtgggcgacatgatcaccgaggaggccctgcccacctaccagaccatgctgaacaccctggacggcgtgcgcgacgagaccggcgcctccctgaccccctgggccatctggacccgcgcctggaccgccgaggagaaccgccacggcgacctgctgaacaagtacctgtacctgtccggccgcgtggacatgaagcagatcgagaagaccatccagtacctgatcggctccggcatggacccccgcaccgagaacaacccctacctgggcttcatctacacctccttccaggagcgcgccaccttcatctcccacggcaacaccgcccgcctggccaaggagcacggcgacctgaagctggcccagatctgcggcatcatcgccgccgacgagaagcgccacgagaccgcctacaccaagatcgtggagaagctgttcgagatcgaccccgacggcaccgtgctggccctggccgacatgatgcgcaagaaggtgtccatgcccgcccacctgatgtacgacggccaggacgacaacctgttcgagaacttctcctccgtggcccagcgcctgggcgtgtacaccgccaaggactacgccgacatcctggagttcctggtgggccgctgggacatcgagaagctgaccggcctgtccggcgagggccgcaaggcccaggactacgtgtgcaccctgcccccccgcatccgccgcctggaggagcgcgcccagtcccgcgtgaagaaggcctccgccacccccttctcctggatcttcggccgcgagatcaacctgatggactacaaggaccacgacggcgactacaaggaccacgacatcgactacaaggacgacgacgacaagtga

SEQ ID NO: 258 - DNA, 6753 bp, Cuphea hookeriana
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgccacccaggaggacgcccactccgccccccccccccgcaccttcatcaaccagctgcccgactggtccatgctgctggccgccatcaccaccgtgttcctggccgccgagaagcagtggatgatgctggactggaagcccaagcgccccgacatgctggtggaccccttcggcctgggctccatcgtgcaggacggcctggtgttccgccagaacttctccatccgctcctacgagatcggcgccgaccgcaccgcctccatcgagaccgtgatgaaccacctgcaggagaccgccctgaaccacgtgaagatcgccggcctgtccaacgacggcttcggccgcacccccgagatgtacaagcgcgacctgatctgggtggtggccaagatgcaggtgatggtgaaccgctaccccacctggggcgacaccgtggaggtgaacacctgggtggccaagtccggcaagaacggcatgcgccgcgactggctgatctccgactgcaacaccggcgagatcctgacccgcgcctcctccgtgtgggtgatgatgaaccagaagacccgccgcctgtccaagatccccgacgaggtgcgcaacgagatcgagccccacttcgtggactccccccccgtgatcgaggacgacgaccgcaagctgcccaagctggacgagaagaccgccgactccatccgcaagggcctgaccccccgctggaacgacctggacgtgaaccagcacgtgaacaacgtgaagtacatcggctggatcctggagtccaccccccccgaggtgctggagacccaggagctgtgctccctgaccctggagtaccgccgcgagtgcggccgcgagtccgtgctggagtccctgaccgccatggacccctccggcggcggctacggctcccagttccagcacctgctgcgcctggaggacggcggcgagatcgtgaagggccgcaccgagtggcgccccaagaacggcgtgatcaacggcgtggtgcccaccggcgagtcctcccccggcgactactccatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 259 - DNA, 1221 bp, Cuphea hookeriana
atggccaccgcatccactttctcggcgttcaatgcccgctgcggcgacctgcgtcgctcggcgggctccgggccccggcgcccagcgaggcccctccccgtgcgcgggcgcgccacccaggaggacgcccactccgccccccccccccgcaccttcatcaaccagctgcccgactggtccatgctgctggccgccatcaccaccgtgttcctggccgccgagaagcagtggatgatgctggactggaagcccaagcgccccgacatgctggtggaccccttcggcctgggctccatcgtgcaggacggcctggtgttccgccagaacttctccatccgctcctacgagatcggcgccgaccgcaccgcctccatcgagaccgtgatgaaccacctgcaggagaccgccctgaaccacgtgaagatcgccggcctgtccaacgacggcttcggccgcacccccgagatgtacaagcgcgacctgatctgggtggtggccaagatgcaggtgatggtgaaccgctaccccacctggggcgacaccgtggaggtgaacacctgggtggccaagtccggcaagaacggcatgcgccgcgactggctgatctccgactgcaacaccggcgagatcctgacccgcgcctcctccgtgtgggtgatgatgaaccagaagacccgccgcctgtccaagatccccgacgaggtgcgcaacgagatcgagccccacttcgtggactccccccccgtgatcgaggacgacgaccgcaagctgcccaagctggacgagaagaccgccgactccatccgcaagggcctgaccccccgctggaacgacctggacgtgaaccagcacgtgaacaacgtgaagtacatcggctggatcctggagtccaccccccccgaggtgctggagacccaggagctgtgctccctgaccctggagtaccgccgcgagtgcggccgcgagtccgtgctggagtccctgaccgccatggacccctccggcggcggctacggctcccagttccagcacctgctgcgcctggaggacggcggcgagatcgtgaagggccgcaccgagtggcgccccaagaacggcgtgatcaacggcgtggtgcccaccggcgagtcctcccccggcgactactccatggactacaaggaccacgacggcgactacaaggaccacgacatcgactacaaggacgacgacgacaagtga

SEQ ID NO: 260 - DNA, 6860 bp, Elaeis guineensis
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggtggcctccatcgccgcctccgccttcttccccaccccctccttctcccccaccgggcgcgccgcctccgccaaggcctccaagaccatcggcgagggctccgagaacctggacgcccgcggcatcatcgccaagcccacctcctcctccgccgccatgcagggcaaggtgatggcccaggccgtgtccaagatcaacggcgccaaggtgggcctgaaggccgagtcccagaaggccgaggaggacgccgccccctcctccgccccccgcaccttctacaaccagctgcccgactggtccgtgctgctggccgccgtgaccaccatcttcctggccgccgagaagcagtggaccctgctggactggaagccccgccgccccgacatgctgaccgacgccttctccctgggcaagatcgtgcaggacggcctggtgttcaagcagaacttctccatccgctcctacgagatcggcgccgaccgcaccgcctccatcgagaccctgatgaaccacctgcaggagaccgccctgaaccacgtgcgctccgccggcctgatgggcgacggcttcggcgccacccccgagatgtccaagcgcaacctgatctgggtggtgaccaaggtgcgcgtgctgatcgagcactacccctcctggggcgacgtggtggaggtggacacctgggtgggccccgccggcaagaacggcatgcgccgcgactggcacgtgcgcgaccaccgcaccggccagaccatcctgcgcgccacccgcgtgtgggtgatgatgaacaagaacacccgcaagctgtccaaggtgcccgaggaggtgcgcgccgagatcggcccctacttcgtggagcgcgccgccatcgtggacgaggactcccgcaagctgcccaagctggacgaggacaccaccgactacgtgaagaagggcctgaccccccgctggtccgacctggacgtgaaccagcacgtgaacaacgtgaagtacatcggctggatcctggagtccgcccccatctccatcctggagaaccacgagctggcctccatgaccctggagtaccgccgcgagtgcggccgcgactccgtgctgcagtccctgaccgccgtggccaacgactgcaccggcggcctgcccgaggcctccatcgagtgccagcacctgctgcagctggagtgcggcgccgagatcgtgcgcggccgcacccagtggcgcccccgccgcgcctccggccccacctccgccggctccgccatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 261 - DNA, 1332 bp, Elaeis guineensis
atggtggcctccatcgccgcctccgccttcttccccaccccctccttctcccccaccgggcgcgccgcctccgccaaggcctccaagaccatcggcgagggctccgagaacctggacgcccgcggcatcatcgccaagcccacctcctcctccgccgccatgcagggcaaggtgatggcccaggccgtgtccaagatcaacggcgccaaggtgggcctgaaggccgagtcccagaaggccgaggaggacgccgccccctcctccgccccccgcaccttctacaaccagctgcccgactggtccgtgctgctggccgccgtgaccaccatcttcctggccgccgagaagcagtggaccctgctggactggaagccccgccgccccgacatgctgaccgacgccttctccctgggcaagatcgtgcaggacggcctggtgttcaagcagaacttctccatccgctcctacgagatcggcgccgaccgcaccgcctccatcgagaccctgatgaaccacctgcaggagaccgccctgaaccacgtgcgctccgccggcctgatgggcgacggcttcggcgccacccccgagatgtccaagcgcaacctgatctgggtggtgaccaaggtgcgcgtgctgatcgagcactacccctcctggggcgacgtggtggaggtggacacctgggtgggccccgccggcaagaacggcatgcgccgcgactggcacgtgcgcgaccaccgcaccggccagaccatcctgcgcgccacccgcgtgtgggtgatgatgaacaagaacacccgcaagctgtccaaggtgcccgaggaggtgcgcgccgagatcggcccctacttcgtggagcgcgccgccatcgtggacgaggactcccgcaagctgcccaagctggacgaggacaccaccgactacgtgaagaagggcctgaccccccgctggtccgacctggacgtgaaccagcacgtgaacaacgtgaagtacatcggctggatcctggagtccgcccccatctccatcctggagaaccacgagctggcctccatgaccctggagtaccgccgcgagtgcggccgcgactccgtgctgcagtccctgaccgccgtggccaacgactgcaccggcggcctgcccgaggcctccatcgagtgccagcacctgctgcagctggagtgcggcgccgagatcgtgcgcggccgcacccagtggcgcccccgccgcgcctccggccccacctccgccggctccgccatggactacaaggaccacgacggcgactacaaggaccacgacatcgactacaaggacgacgacgacaagtga

SEQ ID NO: 262 - DNA, 5937 bp, artificial sequence
  synthetic polynucleotide
gctcttcgggctggtctgaatccttcaggcgggtgttacccgagaaagaaagggtgccgatttcaaagcagacccatgtgccgggccctgtggcctgtgttggcgcctatgtagtcaccccccctcacccaattgtcgccagtttgcgcactccataaactcaaaacagcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgccgccaccggcgagcagccctccggcgtggcctccctgcgcgaggccgacaaggagaagtccctgggcaaccgcctgcgcctgggctccctgaccgaggacggcctgtcctacaaggagaagttcgtgatccgctgctacgaggtgggcatcaacaagaccgccaccatcgagaccatcgccaacctgctgcaggaggtgggcggcaaccacgcccagggcgtgggcttctccaccgacggcttcgccaccaccaccaccatgcgcaagctgcacctgatctgggtgaccgcccgcatgcacatcgagatctaccgctaccccgcctggtccgacgtgatcgagatcgagacctgggtgcagggcgagggcaaggtgggcacccgccgcgactggatcctgaaggactacgccaacggcgaggtgatcggccgcgccacctccaagtgggtgatgatgaacgaggacacccgccgcctgcagaaggtgtccgacgacgtgcgcgaggagtacctggtgttctgcccccgcaccctgcgcctggccttccccgaggagaacaacaactccatgaagaagatccccaagctggaggaccccgccgagtactcccgcctgggcctggtgccccgccgctccgacctggacatgaacaagcacgtgaacaacgtgacctacatcggctgggccctggagtccatcccccccgagatcatcgacacccacgagctgcaggccatcaccctggactaccgccgcgagtgccagcgcgacgacatcgtggactccctgacctcccgcgagcccctgggcaacgccgccggcgtgaagttcaaggagatcaacggctccgtgtcccccaagaaggacgagcaggacctgtcccgcttcatgcacctgctgcgctccgccggctccggcctggagatcaaccgctgccgcaccgagtggcgcaagaagcccgccaagcgcatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgagcgcatcgaggtggtcatctccgacctggcgctggtggcggtgctcagcgggctcagcgtgctgggccgcaccatgggctgggcctggctggtcaagacctacgtggtgccctacctgatcgtgaacatgtggctcgtgctcatcacgctgctccagcacacgcacccggcgctgccgcactacttcgagaaggactgggactggctgcgcggcgccatggccaccgtggaccgctccatgggcccgcccttcatggacaacatcctgcaccacatctccgacacccacgtgctgcaccacctcttcagcaccatcccgcactaccacgccgaggaggcctccgccgccatcaggcccatcctgggcaagtactaccagtccgacagccgctgggtcggccgcgccctgtgggaggactggcgcgactgccgctacgtcgtcccggacgcgcccgaggacgactccgcgctctggttccacaagtgagtgagtgagaagagc

SEQ ID NO: 263 - DNA, 1155 bp, Carthamus tinctorius
atggccaccgcatccactttctcggcgttcaatgcccgctgcggcgacctgcgtcgctcggcgggctccgggccccggcgcccagcgaggcccctccccgtgcgcgggcgcgccgccaccggcgagcagccctccggcgtggcctccctgcgcgaggccgacaaggagaagtccctgggcaaccgcctgcgcctgggctccctgaccgaggacggcctgtcctacaaggagaagttcgtgatccgctgctacgaggtgggcatcaacaagaccgccaccatcgagaccatcgccaacctgctgcaggaggtgggcggcaaccacgcccagggcgtgggcttctccaccgacggcttcgccaccaccaccaccatgcgcaagctgcacctgatctgggtgaccgcccgcatgcacatcgagatctaccgctaccccgcctggtccgacgtgatcgagatcgagacctgggtgcagggcgagggcaaggtgggcacccgccgcgactggatcctgaaggactacgccaacggcgaggtgatcggccgcgccacctccaagtgggtgatgatgaacgaggacacccgccgcctgcagaaggtgtccgacgacgtgcgcgaggagtacctggtgttctgcccccgcaccctgcgcctggccttccccgaggagaacaacaactccatgaagaagatccccaagctggaggaccccgccgagtactcccgcctgggcctggtgccccgccgctccgacctggacatgaacaagcacgtgaacaacgtgacctacatcggctgggccctggagtccatcccccccgagatcatcgacacccacgagctgcaggccatcaccctggactaccgccgcgagtgccagcgcgacgacatcgtggactccctgacctcccgcgagcccctgggcaacgccgccggcgtgaagttcaaggagatcaacggctccgtgtcccccaagaaggacgagcaggacctgtcccgcttcatgcacctgctgcgctccgccggctccggcctggagatcaaccgctgccgcaccgagtggcgcaagaagcccgccaagcgcatggactacaaggaccacgacggcgactacaaggaccacgacatcgactacaaggacgacgacgacaagtga

SEQ ID NO: 264 - DNA, 6758 bp, Myristica fragrans
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggctatcaagacgaacaggcagcctgtggagaagcctccgttcacgatcgggacgctgcgcaaggccatccccgcgcactgtttcgagcgctcggcgcttcgtgggcgcgccgccaacgcccacaccgtgcccaagatcaacggcaacaaggccggcctgctgacccccatggagagcaccaaggacgaggacatcgtcgcggcccccaccgtggcgcccaagcgcaccttcatcaaccagctgcccgactggtcgatgctgctggccgcgatcaccaccatcttcctggcggccgagaagcagtggaccaacctggactggaagccccgccgccccgacatgctggtcgacttcgaccccttctccctgggccgcttcgtgcaggacggcctgatcttccgccagaacttcagcatccgctcgtacgagatcggcgcggaccgcaccgcctccatcgagaccctgatgaaccacctgcaggagaccgcgctgaaccacgtccgctgcatcggcctgctggacgacggcttcggcagcacccccgagatgacccgccgcgacctgatctgggtggtcacccgcatgcaggtcctggtggaccgctacccctcgtggggcgacgtgatcgaggtcgactcctgggtgacccccagcggcaagaacggcatgaagcgcgagtggttcctgcgcgactgcaagaccggcgagatcctgacccgcgccacctcggtctgggtgatgatgaacaagcgcacccgccgcctgtccaagatccccgaggaggtccgcgtggagatcgagccctacttcgtcgagcacggcgtgctggacgaggactcgcgcaagctgcccaagctgaacgacaacaccgccaactacatccgccgcggcctggcgccccgctggtccgacctggacgtcaaccagcacgtgaacaacgtcaagtacatcggctggatcctggagagcgtgcccagcagcctgctggagtcgcacgagctgtacggcatgaccctggagtaccgcaaggagtgcggcaaggacggcctgctgcagtccctgaccgccgtcgccagcgactacggcggcggctcgctggaggccggcgtggagtgcgaccacctgctgcgcctggaggacggctccgagatcatgcgcggcaagaccgagtggcgccccaagcgcgccgcgaacaccacctacttcggcagcgtcgacgacatcccccccgccaacaacgcgtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 265 - DNA, 1248 bp, Myristica fragrans
atggctatcaagacgaacaggcagcctgtggagaagcctccgttcacgatcgggacgctgcgcaaggccatccccgcgcactgtttcgagcgctcggcgcttcgtgggcgcgccgccaacgcccacaccgtgcccaagatcaacggcaacaaggccggcctgctgacccccatggagagcaccaaggacgaggacatcgtcgcggcccccaccgtggcgcccaagcgcaccttcatcaaccagctgcccgactggtcgatgctgctggccgcgatcaccaccatcttcctggcggccgagaagcagtggaccaacctggactggaagccccgccgccccgacatgctggtcgacttcgaccccttctccctgggccgcttcgtgcaggacggcctgatcttccgccagaacttcagcatccgctcgtacgagatcggcgcggaccgcaccgcctccatcgagaccctgatgaaccacctgcaggagaccgcgctgaaccacgtccgctgcatcggcctgctggacgacggcttcggcagcacccccgagatgacccgccgcgacctgatctgggtggtcacccgcatgcaggtcctggtggaccgctacccctcgtggggcgacgtgatcgaggtcgactcctgggtgacccccagcggcaagaacggcatgaagcgcgagtggttcctgcgcgactgcaagaccggcgagatcctgacccgcgccacctcggtctgggtgatgatgaacaagcgcacccgccgcctgtccaagatccccgaggaggtccgcgtggagatcgagccctacttcgtcgagcacggcgtgctggacgaggactcgcgcaagctgcccaagctgaacgacaacaccgccaactacatccgccgcggcctggcgccccgctggtccgacctggacgtcaaccagcacgtgaacaacgtcaagtacatcggctggatcctggagagcgtgcccagcagcctgctggagtcgcacgagctgtacggcatgaccctggagtaccgcaaggagtgcggcaaggacggcctgctgcagtccctgaccgccgtcgccagcgactacggcggcggctcgctggaggccggcgtggagtgcgaccacctgctgcgcctggaggacggctccgagatcatgcgcggcaagaccgagtggcgccccaagcgcgccgcgaacaccacctacttcggcagcgtcgacgacatcccccccgccaacaacgcgtga

SEQ ID NO: 266 - DNA, 1260 bp, Myristica fragrans; identical to SEQ ID NO: 43

SEQ ID NO: 267 - protein, 415 aa, Artificial Sequence; identical to SEQ ID NO: 42
  synthesized construct

SEQ ID NO: 268 - DNA, 5805 bp, Ricinus communis
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgcccgctcctacgaggtgggcatcaacaagaccgccaccgtggagaccatcgccaacctgctgcaggaggtgggctgcaaccacgcccagtccgtgggcttctccaccgacggcttcgccaccaccacctccatgcgcaagatgcacctgatctgggtgaccgcccgcatgcacatcgagatctacaagtaccccgcctggtccgacgtggtggaggtggagacctggtgccagtccgagggccgcatcggcacccgccgcgactggatcctgaccgactacgccaccggccagatcatcggccgcgccacctccaagtgggtgatgatgaaccaggacacccgccgcctgcagaaggtgaccgacgacgtgcgcgaggagtacctggtgttctgcccccgcgagctgcgcctggccttccccgaggagaacaaccgctcctccaagaagatctccaagctggaggaccccgcccagtactccaagctgggcctggtgccccgccgcgccgacctggacatgaaccagcacgtgaacaacgtgacctacatcggctgggtgctggagtccatcccccaggagatcatcgacacccacgagctgcagaccatcaccctggactaccgccgcgagtgccagcacgacgacatcgtggactccctgacctccgtggagccctccgagaacctggaggccgtgtccgagctgcgcggcaccaacggctccgccaccaccaccgccggcgacgaggactgccgcaacttcctgcacctgctgcgcctgtccggcgacggcctggagatcaaccgcggccgcaccgagtggcgcaagaagtccgcccgcatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 269 - DNA, 1026 bp, Ricinus communis
atggccaccgcatccactttctcggcgttcaatgcccgctgcggcgacctgcgtcgctcggcgggctccgggccccggcgcccagcgaggcccctccccgtgcgcgggcgcgcccgctcctacgaggtgggcatcaacaagaccgccaccgtggagaccatcgccaacctgctgcaggaggtgggctgcaaccacgcccagtccgtgggcttctccaccgacggcttcgccaccaccacctccatgcgcaagatgcacctgatctgggtgaccgcccgcatgcacatcgagatctacaagtaccccgcctggtccgacgtggtggaggtggagacctggtgccagtccgagggccgcatcggcacccgccgcgactggatcctgaccgactacgccaccggccagatcatcggccgcgccacctccaagtgggtgatgatgaaccaggacacccgccgcctgcagaaggtgaccgacgacgtgcgcgaggagtacctggtgttctgcccccgcgagctgcgcctggccttccccgaggagaacaaccgctcctccaagaagatctccaagctggaggaccccgcccagtactccaagctgggcctggtgccccgccgcgccgacctggacatgaaccagcacgtgaacaacgtgacctacatcggctgggtgctggagtccatcccccaggagatcatcgacacccacgagctgcagaccatcaccctggactaccgccgcgagtgccagcacgacgacatcgtggactccctgacctccgtggagccctccgagaacctggaggccgtgtccgagctgcgcggcaccaacggctccgccaccaccaccgccggcgacgaggactgccgcaacttcctgcacctgctgcgcctgtccggcgacggcctggagatcaaccgcggccgcaccgagtggcgcaagaagtccgcccgcatggactacaaggaccacgacggcgactacaaggaccacgacatcgactacaaggacgacgacgacaagtga

SEQ ID NO: 270 - DNA, 5110 bp, Cinnamomum camphora
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctccttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 271 - DNA, 1152 bp, Cinnamomum camphora; identical to SEQ ID NO: 91

SEQ ID NO: 272 - DNA, 5576 bp, Cinnamomum camphora; identical to SEQ ID NO: 51

SEQ ID NO: 273 - DNA, 6981 bp, Cinnamomum camphora; identical to SEQ ID NO: 90

SEQ ID NO: 274 - DNA, 5923 bp, Artificial Sequence
  synthetic polynucleotide
gctcttccgcctggagctggtgcagagcatggggcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattgacggagcgtcgtgcgggagggagtgtgccgagcggggagtcccggtctgtgcgaggcccggcagctgacgctggcgagccgtacgccccgagggtccccctcccctgcaccctcttccccttccctctgacggccgcgcctgttcttgcatgttcagcgacggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgcccagctgcccgactggagcatgctgctggccgcgatcaccaccctgttcctggcggccgagaagcagtggatgatgctggactggaagcccaagcgccccgacatgctggtggaccccttcggcctgggccgcttcgtgcaggacggcctggtgttccgcaacaacttcagcatccgcagctacgagatcggcgcggaccgcaccgccagcatcgagaccctgatgaaccacctgcaggagaccgccctgaaccacgtgaagagtgtgggcctgctggaggacggcctgggcagcacccgcgagatgagcctgcgcaacctgatctgggtggtgaccaagatgcaggtggcggtggaccgctaccccacctggggcgacgaggtgcaggtgagcagctgggcgaccgccatcggcaagaacggcatgcgccgcgagtggatcgtgaccgacttccgcaccggcgagaccctgctgcgcgccaccagcgtgtgggtgatgatgaacaagctgacccgccgcatcagcaagatccccgaggaggtgtggcacgagatcggccccagcttcatcgacgcgccccccctgcccaccgtggaggacgacggccgcaagctgacccgcttcgacgagagcagcgccgacttcatccgcaagggcctgaccccccgctggagcgacctggacatcaaccagcacgtgaacaacgtgaagtacatcggctggctgctggagagcgcgccccccgagatccacgagagccacgagatcgccagcctgaccctggagtaccgccgcgagtgcggccgcgacagcgtgctgaacagcgccaccaaggtgagcgacagcagccagctgggcaagagcgccgtggagtgcaaccacctggtgcgcctgcagaacggcggcgagatcgtgaagggccgcaccgtgtggcgccccaagcgccccctgtacaacgacggcgccgtggtggacgtgcccgccaagaccagctgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctccagccacggcaacaccgcgcgccttgcggccgagcacggcgacaagaacctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactactgccgcatcctggagcacctcaacgcgcgctggaaggtggacgagcgccaggtcagcggccaggccgccgcggaccaggagtacgtcctgggcctgccccagcgcttccggaaactcgccgagaagaccgccgccaagcgcaagcgcgtcgcgcgcaggcccgtcgccttctcctggagaagagc

SEQ ID NO: 275 - DNA, 1110 bp, Ulmus americana
atggccaccgcatccactttctcggcgttcaatgcccgctgcggcgacctgcgtcgctcggcgggctccgggccccggcgcccagcgaggcccctccccgtgcgcgggcgcgcccagctgcccgactggagcatgctgctggccgcgatcaccaccctgttcctggcggccgagaagcagtggatgatgctggactggaagcccaagcgccccgacatgctggtggaccccttcggcctgggccgcttcgtgcaggacggcctggtgttccgcaacaacttcagcatccgcagctacgagatcggcgcggaccgcaccgccagcatcgagaccctgatgaaccacctgcaggagaccgccctgaaccacgtgaagagtgtgggcctgctggaggacggcctgggcagcacccgcgagatgagcctgcgcaacctgatctgggtggtgaccaagatgcaggtggcggtggaccgctaccccacctggggcgacgaggtgcaggtgagcagctgggcgaccgccatcggcaagaacggcatgcgccgcgagtggatcgtgaccgacttccgcaccggcgagaccctgctgcgcgccaccagcgtgtgggtgatgatgaacaagctgacccgccgcatcagcaagatccccgaggaggtgtggcacgagatcggccccagcttcatcgacgcgccccccctgcccaccgtggaggacgacggccgcaagctgacccgcttcgacgagagcagcgccgacttcatccgcaagggcctgaccccccgctggagcgacctggacatcaaccagcacgtgaacaacgtgaagtacatcggctggctgctggagagcgcgccccccgagatccacgagagccacgagatcgccagcctgaccctggagtaccgccgcgagtgcggccgcgacagcgtgctgaacagcgccaccaaggtgagcgacagcagccagctgggcaagagcgccgtggagtgcaaccacctggtgcgcctgcagaacggcggcgagatcgtgaagggccgcaccgtgtggcgccccaagcgccccctgtacaacgacggcgccgtggtggacgtgcccgccaagaccagctga

SEQ ID NO: 276 - DNA, 10326 bp, Artificial Sequence
  synthesized polynucleotide
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagcatattcaaacacctagatcactaccacttctacacaggccactcgagcttgtgatcgcactccgctaagggggcgcctcttcccttcgtttcagtcacaacccgcaaacggcgcgccatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagcccatatggccaccgcatccactttctcggcgttcaatgcccgctgcggcgacctgcgtcgctcggcgggctccgggccccggcgcccagcgaggcccctccccgtgcgctacgtattccagtgcctggtggccagctgcatcgacccctgcgaccagtaccgcagcagcgccagcctgagcttcctgggcgacaacggcttcgccagcctgttcggcagcaagcccttcatgagcaaccgcggccaccgccgcctgcgccgcgccagccacagcggcgaggccatggccgtggccctgcagcccgcccaggaggccggcaccaagaagaagcccgtgatcaagcagcgccgcgtggtggtgaccggcatgggcgtggtgacccccctgggccacgagcccgacgtgttctacaacaacctgctggacggcgtgagcggcatcagcgagatcgagaccttcgactgcacccagttccccacccgcatcgccggcgagatcaagagcttcagcaccgacggctgggtggcccccaagctgagcaagcgcatggacaagttcatgctgtacctgctgaccgccggcaagaaggccctggccgacggcggcatcaccgacgaggtgatgaaggagctggacaagcgcaagtgcggcgtgctgatcggcagcggcatgggcggcatgaaggtgttcaacgacgccatcgaggccctgcgcgtgagctacaagaagatgaaccccttctgcgtgcccttcgccaccaccaacatgggcagcgccatgctggccatggacctgggctggatgggccccaactacagcatcagcaccgcctgcgccaccagcaacttctgcatcctgaacgccgccaaccacatcatccgcggcgaggccgacatgatgctgtgcggcggcagcgacgccgtgatcatccccatcggcctgggcggcttcgtggcctgccgcgccctgagccagcgcaacagcgaccccaccaaggccagccgcccctgggacagcaaccgcgacggcttcgtgatgggcgagggcgccggcgtgctgctgctggaggagctggagcacgccaagaagcgcggcgccaccatctacgccgagttcctgggcggcagcttcacctgcgacgcctaccacatgaccgagccccaccccgagggcgccggcgtgatcctgtgcatcgagaaggccctggcccaggccggcgtgagcaaggaggacgtgaactacatcaacgcccacgccaccagcaccagcgccggcgacatcaaggagtaccaggccctggcccgctgcttcggccagaacagcgagctgcgcgtgaacagcaccaagagcatgatcggccacctgctgggcgccgccggcggcgtggaggccgtgaccgtggtgcaggccatccgcaccggctggattcaccccaacctgaacctggaggaccccgacaaggccgtggacgccaagctgctggtgggccccaagaaggagcgcctgaacgtgaaggtgggcctgagcaacagcttcggcttcggcggccacaacagcagcatcctgttcgccccctgcaacgtgtgaatgcatacggagcgtcgtgcgggagggagtgtgccgagcggggagtcccggtctgtgcgaggcccggcagctgacgctggcgagccgtacgccccgagggtccccctcccctcccccctcttccccttccctctgacggccgcgcctgtttttgcatgttcagcgaccttaaggatctaagtaagattcgaagcgctcgaccgtgccggacggactgcagccccatgtcgtagtgaccgccaatgtaagtgggctggcgtttccctgtacgtgactcaacgtcactgcacgcgcaccaccctctcgaccggcaggaccaggcatcgcgagatacagcgcgagccagacacggagtgccgagctatgcgcacgctccaactagatatcgaattcggcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgcccccaaggccaacggcagcgccgtgagcctgaagtccggcagcctgaacaccctggaggacccccccagcagcccccccccccgcaccttcctgaaccagctgcccgactggagccgcctgcgcaccgccatcaccaccgtgttcgtggccgccgagaagcagttcacccgcctggaccgcaagagcaagcgccccgacatgctggtggactggttcggcagcgagaccatcgtgcaggacggcctggtgttccgcgagcgcttcagcatccgcagctacgagatcggcgccgaccgcaccgccagcatcgagaccctgatgaaccacctgcaggacaccagcctgaaccactgcaagagcgtgggcctgctgaacgacggcttcggccgcacccccgagatgtgcacccgcgacctgatctgggtgctgaccaagatgcagatcgtggtgaaccgctaccccacctggggcgacaccgtggagatcaacagctggttcagccagagcggcaagatcggcatgggccgcgagtggctgatcagcgactgcaacaccggcgagatcctggtgcgcgccaccagcgcctgggccatgatgaaccagaagacccgccgcttcagcaagctgccctgcgaggtgcgccaggagatcgccccccacttcgtggacgccccccccgtgatcgaggacaacgaccgcaagctgcacaagttcgacgtgaagaccggcgacagcatctgcaagggcctgacccccggctggaacgacttcgacgtgaaccagcacgtgagcaacgtgaagtacatcggctggattctggagagcatgcccaccgaggtgctggagacccaggagctgtgcagcctgaccctggagtaccgccgcgagtgcggccgcgagagcgtggtggagagcgtgaccagcatgaaccccagcaaggtgggcgaccgcagccagtaccagcacctgctgcgcctggaggacggcgccgacatcatgaagggccgcaccgagtggcgccccaagaacgccggcaccaaccgcgccatcagcacctgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 277 - DNA, 1584 bp, Cuphea wrightii
atggccaccgcatccactttctcggcgttcaatgcccgctgcggcgacctgcgtcgctcggcgggctccgggccccggcgcccagcgaggcccctccccgtgcgctacgtattccagtgcctggtggccagctgcatcgacccctgcgaccagtaccgcagcagcgccagcctgagcttcctgggcgacaacggcttcgccagcctgttcggcagcaagcccttcatgagcaaccgcggccaccgccgcctgcgccgcgccagccacagcggcgaggccatggccgtggccctgcagcccgcccaggaggccggcaccaagaagaagcccgtgatcaagcagcgccgcgtggtggtgaccggcatgggcgtggtgacccccctgggccacgagcccgacgtgttctacaacaacctgctggacggcgtgagcggcatcagcgagatcgagaccttcgactgcacccagttccccacccgcatcgccggcgagatcaagagcttcagcaccgacggctgggtggcccccaagctgagcaagcgcatggacaagttcatgctgtacctgctgaccgccggcaagaaggccctggccgacggcggcatcaccgacgaggtgatgaaggagctggacaagcgcaagtgcggcgtgctgatcggcagcggcatgggcggcatgaaggtgttcaacgacgccatcgaggccctgcgcgtgagctacaagaagatgaaccccttctgcgtgcccttcgccaccaccaacatgggcagcgccatgctggccatggacctgggctggatgggccccaactacagcatcagcaccgcctgcgccaccagcaacttctgcatcctgaacgccgccaaccacatcatccgcggcgaggccgacatgatgctgtgcggcggcagcgacgccgtgatcatccccatcggcctgggcggcttcgtggcctgccgcgccctgagccagcgcaacagcgaccccaccaaggccagccgcccctgggacagcaaccgcgacggcttcgtgatgggcgagggcgccggcgtgctgctgctggaggagctggagcacgccaagaagcgcggcgccaccatctacgccgagttcctgggcggcagcttcacctgcgacgcctaccacatgaccgagccccaccccgagggcgccggcgtgatcctgtgcatcgagaaggccctggcccaggccggcgtgagcaaggaggacgtgaactacatcaacgcccacgccaccagcaccagcgccggcgacatcaaggagtaccaggccctggcccgctgcttcggccagaacagcgagctgcgcgtgaacagcaccaagagcatgatcggccacctgctgggcgccgccggcggcgtggaggccgtgaccgtggtgcaggccatccgcaccggctggattcaccccaacctgaacctggaggaccccgacaaggccgtggacgccaagctgctggtgggccccaagaaggagcgcctgaacgtgaaggtgggcctgagcaacagcttcggcttcggcggccacaacagcagcatcctgttcgccccctgcaacgtgtga

SEQ ID NO: 278 - DNA, 1173 bp, Cuphea wrightii
atggccaccgcatccactttctcggcgttcaatgcccgctgcggcgacctgcgtcgctcggcgggctccgggccccggcgcccagcgaggcccctccccgtgcgcgggcgcgcccccaaggccaacggcagcgccgtgagcctgaagtccggcagcctgaacaccctggaggacccccccagcagcccccccccccgcaccttcctgaaccagctgcccgactggagccgcctgcgcaccgccatcaccaccgtgttcgtggccgccgagaagcagttcacccgcctggaccgcaagagcaagcgccccgacatgctggtggactggttcggcagcgagaccatcgtgcaggacggcctggtgttccgcgagcgcttcagcatccgcagctacgagatcggcgccgaccgcaccgccagcatcgagaccctgatgaaccacctgcaggacaccagcctgaaccactgcaagagcgtgggcctgctgaacgacggcttcggccgcacccccgagatgtgcacccgcgacctgatctgggtgctgaccaagatgcagatcgtggtgaaccgctaccccacctggggcgacaccgtggagatcaacagctggttcagccagagcggcaagatcggcatgggccgcgagtggctgatcagcgactgcaacaccggcgagatcctggtgcgcgccaccagcgcctgggccatgatgaaccagaagacccgccgcttcagcaagctgccctgcgaggtgcgccaggagatcgccccccacttcgtggacgccccccccgtgatcgaggacaacgaccgcaagctgcacaagttcgacgtgaagaccggcgacagcatctgcaagggcctgacccccggctggaacgacttcgacgtgaaccagcacgtgagcaacgtgaagtacatcggctggattctggagagcatgcccaccgaggtgctggagacccaggagctgtgcagcctgaccctggagtaccgccgcgagtgcggccgcgagagcgtggtggagagcgtgaccagcatgaaccccagcaaggtgggcgaccgcagccagtaccagcacctgctgcgcctggaggacggcgccgacatcatgaagggccgcaccgagtggcgccccaagaacgccggcaccaaccgcgccatcagcacctga

SEQ ID NO: 279 - DNA, 1404 bp, Artificial Sequence
  synthesized nucleotide
atgcagaccgcgcaccagcggcccccgaccgaggggcactgcttcggtgcgaggctgcccacggcgtcgaggcgggcggtgcgccgggcatggtcccgcatcgcgcgcgcggcggccgcggccgacgcaaaccccgcccgccctgagcgccgcgtggtcatcacgggccagggcgtggtgaccagcctgggccagacgatcgagcagttttacagcagcctgctggagggcgtgagcggcatctcgcagatacagaagttcgacaccacgggctacacgacgacgatcgcgggcgagatcaagtcgctgcagctggacccgtacgtgcccaagcgctgggcgaagcgcgtggacgacgtgataaagtacgtctacatcgcgggcaagcaggcgctggagagcgccggcctgccgatcgaggcggcggggctggcgggcgcggggctggacccggcgctgtgcggcgtgctcatcggcaccgccatggcgggcatgacgtctttcgcggcgggcgtggaggcgctgacgcgcggcggcgtgcgcaagatgaaccccttttgcatccccttctccatctccaacatgggcggcgcgatgctggcgatggacatcggcttcatgggccccaactactccatctccacggcctgcgcgacgggcaactactgcatcctgggcgcggcggaccacatccggcgcggcgacgcaaacgtgatgctggccggcggcgcggacgcggccatcatcccctcgggcatcggcggcttcatcgcgtgcaaggcgctgagcaagcgcaacgacgagcccgagcgcgcgagccggccctgggacgccgaccgcgacggcttcgtcatgggcgagggcgccggcgtgctggtgctggaggagctggagcacgccaagcgccgcggcgcgaccattttggctgaattagttggcggcgcggccacctcggacgcgcaccacatgaccgagcccgacccgcagggccgcggcgtgcgcctctgcctcgagcgcgcgctcgagcgcgcgcgcctcgcgcccgagcgcgtcggctacgtcaacgcgcacggcaccagcacgcccgcgggcgacgtggccgagtaccgcgccatccgcgccgtcatcccgcaggactcactacgcatcaactccacaaagtccatgatcgggcacctgctcggcggcgccggcgcggtcgaggccgtggccgccatccaggccctgcgcaccggctggctccaccccaacttgaacctcgagaaccccgcgcctggcgtcgaccccgtcgtgctcgtggggccgcggaaggagcgcgccgaagacctggacgtcgtcctctccaactcctttggctttggcgggcacaattcgtgcgtcatcttccgaaagtacgacgagtga

SEQ ID NO: 280 - DNA, 1404 bp, Artificial Sequence
  synthesized nucleotide
atgcagaccgcgcaccagcggcccccgaccgaggggcactgcttcggtgcgaggctgcccacggcgtcgaggcgggcggtgcgccgggcgtggtcccgcatcgcgcgcgcggcggccgcggccgacgcgacccccgcccgccctccgcgccgcgtggtcgtgacgggccagggcgtggtgaccagcctgggccagacgatcgagcagttttacagcagcctgctggagggcgtgagcggcatctcgcagatccaaaagtttgacaccacgggctacacgacgacgatcgcgggcgagatcaagtcgctgcagctggacccgtacgtgcccaagcgctgggccaagcgcgtggacgacgtcatcaagtacgtctacatcgcgggcaagcaggcgctggagaacgcggggctgccgatcgaggcggcggggctggcgggcgcggggctggaccccgcgctgtgcggcgtgctcatcggcaccgccatggcgggcatgacgtccttcgcggcgggcgtggaggcgctgacgcgcggcggcgtgcgcaagatgaaccccttttgcatccccttctccatctccaacatgggcggcgcgatgctggcgatggacatcggcttcatgggccccaactactccatctccacggcctgcgcgacgggcaactactgcatcctgggcgcggcggaccacatccggcgcggcgacgcggacgtgatgctggccggcggcgcggacgcggccatcatcccctcgggcatcggcggcttcatcgcgtgcaaggcgctgagcaagcgcaacgacgagcccgagcgcgcgagccggccctgggacgccgaccgcgacggcttcgtcatgggcgagggcgccggcgtgctggtgctggaggagctggagcacgccaagcgccgcggcgcgaccatcctggccgaattcgtcggcggcgcggccacctcggacgcgcaccacatgaccgagccggacccgcagggccgcggcgtgcgcctctgcctcgaacgcgcgctcgagcgcgcgcgcctcgcgcccgagcgcgtcggctacgtcaacgcgcacggcaccagcacgcccgcgggcgacgtggccgagtaccgcgccatccgcgccgtcatcccgcaggactcgctgcgcatcaactccaccaagtccatgatcgggcacctgctcggcggcgccggcgcggtcgaggccgtggccgccatccaggccctgcgcaccggctggctccaccccaacctcaacctcgagaaccccgcacccggggtcgaccccgtcgtgctcgtggggccgcgcaaggagcgcgccgaagacctcgacgtcgtcctctccaactcctttggcttcggcgggcacaactcgtgcgtcatcttccaaaagtacgacgagtga

SEQ ID NO: 281 - protein, 467 aa, Artificial Sequence
  synthesized construct
MQTAHQRPPTEGHCFGARLPTASRRAVRRAWSRIARAAAAADANPARPERRVVITGQGVVTSLGQTIEQFYSSLLEGVSGISQIQKFDTTGYTTTIAGEIKSLQLDPYVPKRWAKRVDDVIKYVYIAGKQALESAGLPIEAAGLAGAGLDPALCGVLIGTAMAGMTSFAAGVEALTRGGVRKMNPFCIPFSISNMGGAMLAMDIGFMGPNYSISTACATGNYCILGAADHIRRGDANVMLAGGADAAIIPSGIGGFIACKALSKRNDEPERASRPWDADRDGFVMGEGAGVLVLEELEHAKRRGATILAELVGGAATSDAHHMTEPDPQGRGVRLCLERALERARLAPERVGYVNAHGTSTPAGDVAEYRAIRAVIPQDSLRINSTKSMIGHLLGGAGAVEAVAAIQALRTGWLHPNLNLENPAPGVDPVVLVGPRKERAEDLDVVLSNSFGFGGHNSCVIFRKYDE

SEQ ID NO: 282 - protein, 467 aa, Artificial Sequence
  synthesized construct
MQTAHQRPPTEGHCFGARLPTASRRAVRRAWSRIARAAAAADATPARPPRRVVVTGQGVVTSLGQTIEQFYSSLLEGVSGISQIQKFDTTGYTTTIAGEIKSLQLDPYVPKRWAKRVDDVIKYVYIAGKQALENAGLPIEAAGLAGAGLDPALCGVLIGTAMAGMTSFAAGVEALTRGGVRKMNPFCIPFSISNMGGAMLAMDIGFMGPNYSISTACATGNYCILGAADHIRRGDADVMLAGGADAAIIPSGIGGFIACKALSKRNDEPERASRPWDADRDGFVMGEGAGVLVLEELEHAKRRGATILAEFVGGAATSDAHHMTEPDPQGRGVRLCLERALERARLAPERVGYVNAHGTSTPAGDVAEYRAIRAVIPQDSLRINSTKSMIGHLLGGAGAVEAVAAIQALRTGWLHPNLNLENPAPGVDPVVLVGPRKERAEDLDVVLSNSFGFGGHNSCVIFQKYDE

SEQ ID NO: 283 - DNA, 2678 bp, Artificial Sequence; identical to SEQ ID NO: 149
  synthetic construct

SEQ ID NO: 284 - DNA, 717 bp, Ganoderma tsugae
ctccaccacaagaagcaccaccagacctacgtgaacgcgctcaacgccgcagagcaggcctacgccaaggccaccacccccaaggagcgcatcgccctccagtccgccctcaagttcaacggcggtggtgagtgaatttcgcgaatgtcggctcaccgcgacgcgattacgaatccgctaactctaacactttgctgcgggggatgtgcaggtcacatcaaccactccctcttctggaagaacctcgccccagccaagtctgagggcaagggaaacggcggcgccatcaaggacggccccctcaagtcggcgatcgagcagaactttggttccgtcgacgtcttcatcaaggagttcaacgcgaccaccgcgtccatccagggctccggctggggctggctcgtgagtcttctcttctgcgatcggaaggcgcatccggtgttatggtcgcgcgctgcacgcgtgtctcgcttcggctccgccgtcgaagcgctgataccgagaccgatctgctgcaaatcatttgcgctgcgatagagctccgggggctttaacccttcgttccatgtgataagaccgcgtctgaccgggtggtgttttctatcgcagggtctcaacccggcgaccaagcgcctcgagatcacgacgacggccaaccaggaccctctcctcacgcacgtccccatcatcggcgtcgacatctgggagcacgcgttc

SEQ ID NO: 285 - DNA, 1561 bp, Umbellularia californica
agagagagagagagagagagagctaaattaaaaaaaaaacccagaagtgggaaatcttccccatgaaataacggatcctcttgctactgctactactactactacaaactgtagccatttatataattctatataattttcaacatggccaccacctctttagcttccgctttctgctcgatgaaagctgtaatgttggctcgtgatggccggggcatgaaacccaggagcagtgatttgcagctgagggcgggaaatgcgccaacctctttgaagatgatcaatgggaccaagttcagttacacggagagcttgaaaaggttgcctgactggagcatgctctttgcagtgatcacaaccatcttttcggctgctgagaagcagtggaccaatctagagtggaagccgaagccgaagctaccccagttgcttgatgaccattttggactgcatgggttagttttcaggcgcacctttgccatcagatcttatgaggtgggacctgaccgctccacatctatactggctgttatgaatcacatgcaggaggctacacttaatcatgcgaagagtgtgggaattctaggagatggattcgggacgacgctagagatgagtaagagagatctgatgtgggttgtgagacgcacgcatgttgctgtggaacggtaccctacttggggtgatactgtagaagtagagtgctggattggtgcatctggaaataatggcatgcgacgtgatttccttgtccgggactgcaaaacaggcgaaattcttacaagatgtaccagcctttcggtgctgatgaatacaaggacaaggaggttgtccacaatccctgacgaagttagaggggagatagggcctgcattcattgataatgtggctgtcaaggacgatgaaattaagaaactacagaagctcaatgacagcactgcagattacatccaaggaggtttgactcctcgatggaatgatttggatgtcaatcagcatgtgaacaacctcaaatacgttgcctgggtttttgagaccgtcccagactccatctttgagagtcatcatatttccagcttcactcttgaatacaggagagagtgcacgagggatagcgtgctgcggtccctgaccactgtctctggtggctcgtcggaggctgggttagtgtgcgatcacttgctccagcttgaaggtgggtctgaggtattgagggcaagaacagagtggaggcctaagcttaccgatagtttcagagggattagtgtgatacccgcagaaccgagggtgtaactaatgaaagaagcatctgttgaagtttctcccatgctgttcgtgaggatactttttagaagctgcagtttgcattgcttgtgcagaatcatggtctgtggttttagatgtatataaaaaatagtcctgtagtcatgaaacttaatatcagaaaaataactcaatgggtcaaggttatcgaagtagtcatttaagctttgaaatatgttttgtattcctcggcttaatctgtaagctctttctcttgcaataaagttcgcctttcaat

SEQ ID NO: 286 - protein, 417 aa, Cuphea calophylla
MVAAEASSALFSVRTPGTSPKPGKFRNWPSSLSVPFKSKSNHNGGFQVKANASARPKANGSAVSLKSGSLDTQEDTSSSSSPPRTFINQLPDWSMLLSAITTVFVAAEKQWTMLDRKSKRPDTLMDPFGVDRVVQDGVVFRQSFSIRSYEIGADRTASIETLMNIFQETSLNHCKSIGLLNDGFGRTPEMCKRDLIWVVTKMHIEVNRYPTWGDTIEVNTWVSESGKTGMGRDWLISDCHTGEILIRATSVCAMMNQTTRRFSKFPYEVRQELAPHFVDSAPVIEDYQKLHKLDVKTGDSICNGLTPRWNDLDVNQHVNNVKYIGWILESVPKEVFETQELCGLTLEYRRECGRDSVLKSVTAMDPSKEGDRSLYQHLLRLEDGTDIAKGRTKWRPKNAGTNGAISTGKTSNGNSIS

SEQ ID NO: 287 - protein, 378 aa, Ulmus americana
  misc_feature (265)..(265): Xaa can be any naturally occurring amino acid
  misc_feature (374)..(374): Xaa can be any naturally occurring amino acid
GSGALQVKASSQAPPKLNGSNVGLVKSSQIVKKGDDTTSPPARTFINQLPDWSMLLAAITTLFLAAEKQWMMLDWKPKRPDMLVDPFGLGRFVQDGLVFRNNFSIRSYEIGADRTASIETLMNHLQETALNHVKSVGLLEDGLGSTREMSLRNLIWVVTKMQVAVDRYPTWGDEVQVSSWATAIGKNGMRREWIVTDFRTGETLLRATSVWVMMNKLTRRISKIPEEVWHEIGPSFIDAPPLPTVEDDGRKLTRFDESSADFIRXGLTPRWSDLDINQHVNNVKYIGWLLESAPPEIHESHEIASLTLEYRRECGRDSVLNSATKVSDSSQLGKSAVECNHLVRLQNGGEIVKGRTVWRPKRPLYNDGAVVDVXAKTS

What is claimed is:

1. An oil composition produced by cultivating an oleaginous microbe and recovering the oil composition from the microbe, the oil composition comprising triglycerides and sterols produced by the microbe, wherein the fatty acid profile of the triglyceride oil composition comprises at least 60% C18:1, and less than 7% C18:2, wherein the triglyceride oil composition is produced by a recombinant oleaginous microbe comprising an exogenous gene, and optionally wherein an endogenous desaturase of the oleaginous microbe has been inactivated or mutated to have less enzymatic activity.

2. The oil composition of claim 1, wherein the fatty acid profile of the triglyceride oil composition comprises at least 70% C18:1.

3. The oil composition of claim 2, wherein the fatty acid profile of the triglyceride oil composition comprises at least 80% C18:1.

4. The oil composition of claim 3, wherein the fatty acid profile of the triglyceride oil composition comprises at least 90% C18:1.

5. The oil composition of claim 1, wherein the fatty acid profile of the triglyceride oil composition comprises less than 5% C18:2.

6. The oil composition of claim 5, wherein the fatty acid profile of the triglyceride oil composition comprises less than 3% C18:2.

7. The oil composition of claim 6, wherein the fatty acid profile of the triglyceride oil composition comprises less than 2% C18:2.

8. The oil composition of claim 1, wherein the fatty acid profile of the triglyceride oil composition comprises at least 80% C18:1 and less than 5% C18:2.

9. The oil composition of claim 8, wherein the fatty acid profile of the triglyceride oil composition comprises at least 80% C18:1 and less than 3% C18:2.

10. The oil composition of claim 9, wherein the fatty acid profile of the triglyceride oil composition comprises at least 90% C18:1 and less than 3% C18:2.

11. The oil composition of claim 10, wherein the fatty acid profile of the triglyceride oil composition comprises at least 90% C18:1 and less than 2% C18:2.

12. An oil composition produced by cultivating an oleaginous microalgae and recovering the oil composition from the microalgae, the oil composition comprising triglycerides and sterols produced by the microalgae, wherein the fatty acid profile of the triglyceride oil composition comprises at least 60% C18:1, and less than 7% C18:2, wherein the triglyceride oil composition is produced by a recombinant oleaginous microalgae comprising an exogenous gene, and optionally wherein an endogenous desaturase of the oleaginous microalgae has been inactivated or mutated to have less enzymatic activity.

13. The oil composition of claim 12, wherein the microalgae is *Prototheca*.

14. The oil composition of claim 13, wherein the microalgae is *Prototheca moriformis*.

15. The oil composition of claim 13, wherein the fatty acid profile of the triglyceride oil composition comprises at least 70% C18:1.

16. The oil composition of claim 15, wherein the fatty acid profile of the triglyceride oil composition comprises at least 80% C18:1.

17. The oil composition of claim 16, wherein the fatty acid profile of the triglyceride oil composition comprises at least 90% C18:1.

18. The oil composition of claim 13, wherein the fatty acid profile of the triglyceride oil composition comprises less than 5% C18:2.

19. The oil composition of claim 18, wherein the fatty acid profile of the triglyceride oil composition comprises less than 3% C18:2.

20. The oil composition of claim 19, wherein the fatty acid profile of the triglyceride oil composition comprises less than 2% C18:2.

21. The oil composition of claim 13, wherein the fatty acid profile of the triglyceride oil composition comprises at least 80% C18:1 and less than 5% C18:2.

22. The oil composition of claim 21, wherein the fatty acid profile of the triglyceride oil composition comprises at least 80% C18:1 and less than 3% C18:2.

23. The oil composition of claim 22, wherein the fatty acid profile of the triglyceride oil composition comprises at least 90% C18:1 and less than 3% C18:2.

24. The oil composition of claim 23, wherein the fatty acid profile of the triglyceride oil composition comprises at least 90% C18:1 and less than 2% C18:2.

25. The oil composition of claim 13, wherein the fatty acid profile of the triglyceride oil composition comprises at least 80% C18:1 and less than 1% C18:2.

26. The oil of claim 12, wherein the microalgae comprises 23S rRNA having at least 85% sequence identity to SEQ ID NO:15.

27. The oil of claim 12, wherein the microalgae comprises 23S rRNA having at least 90% sequence identity to SEQ ID NO:15.

28. The oil of claim 12, wherein the microalgae comprises 23S rRNA having at least 95% sequence identity to SEQ ID NO:15.

29. An oil composition, produced by cultivating an oleaginous microbe and recovering the oil composition from the microbe, the oil composition comprising triglycerides and sterols produced by the microbe, wherein the fatty acid profile of the triglyceride oil composition comprises at least 50% saturated fatty acids, wherein the triglyceride oil composition is produced by a recombinant oleaginous microbe comprising an exogenous gene, and optionally wherein an endogenous desaturase of the oleaginous microbe has been inactivated or mutated to have less enzymatic activity.

30. The oil composition of claim 29, wherein the fatty acid profile of the triglyceride oil composition comprises at least 70% saturated fatty acids.

31. The oil composition of claim 30, wherein the fatty acid profile of the triglyceride oil composition comprises at least 80% saturated fatty acids.

32. The oil composition of claim 31, wherein the fatty acid profile of the triglyceride oil composition comprises at least 90% saturated fatty acids.

33. The oil composition of claim 32, wherein the saturated fatty acids comprie at least 30% C12:0.

34. The oil composition of claim 33, wherein the saturated fatty acids comprise at least 40% C12:0.

35. The oil composition of claim 34, wherein the saturated fatty acids comprise at least 50% C12:0.

36. The oil of claim 29, wherein the microbe is a microalgae.

37. The oil of claim 36, wherein the microalgae comprises 23S rRNA having at least 85% sequence identity to SEQ ID NO:15.

38. The oil of claim 36, wherein the microalgae comprises 23S rRNA having at least 90% sequence identity to SEQ ID NO:15.

39. The oil of claim 36, wherein the microalgae comprises 23S rRNA having at least 95% sequence identity to SEQ ID NO:15.

* * * * *

UNITED STATES PATENT AND TRADEMARK OFFICE
CERTIFICATE OF CORRECTION

PATENT NO.        : 8,592,188 B2                              Page 1 of 1
APPLICATION NO.   : 13/118365
DATED             : November 26, 2013
INVENTOR(S)       : Scott Franklin et al.

It is certified that error appears in the above-identified patent and that said Letters Patent is hereby corrected as shown below:

In the Claims

In Claim 33, at Column 142, line 34, delete "comprie"

and replace it with --comprise--.

Signed and Sealed this
Twenty-first Day of October, 2014

Michelle K. Lee
*Deputy Director of the United States Patent and Trademark Office*